United States Patent
Crine et al.

(10) Patent No.: US 10,052,366 B2
(45) Date of Patent: Aug. 21, 2018

(54) COMPOSITIONS COMPRISING ALKALINE PHOSPHATASE AND/OR NATRIURETIC PEPTIDE AND METHODS OF USE THEREOF

(71) Applicants: Alexion Pharma International Sàrl, Lausanne (CH); Vanderbilt University, Nashville, TN (US)

(72) Inventors: Philippe Crine, Outremont (CA); Florent Elefteriou, Nashville, TN (US)

(73) Assignees: Alexion Pharmaceuticsl, Inc., New Haven, CT (US); Vanderbilt University, Nashville, TN (US)

( * ) Notice: Subject to any disclaimer, the term of this patent is extended or adjusted under 35 U.S.C. 154(b) by 871 days.

(21) Appl. No.: 13/899,359

(22) Filed: May 21, 2013

(65) Prior Publication Data
US 2013/0323244 A1  Dec. 5, 2013

Related U.S. Application Data

(60) Provisional application No. 61/649,717, filed on May 21, 2012.

(51) Int. Cl.
| | | |
|---|---|---|
| C12N 9/16 | (2006.01) | |
| A61K 38/46 | (2006.01) | |
| A61K 38/10 | (2006.01) | |
| C07K 7/08 | (2006.01) | |
| C07K 14/58 | (2006.01) | |

(52) U.S. Cl.
CPC ............ *A61K 38/465* (2013.01); *A61K 38/10* (2013.01); *C07K 7/08* (2013.01); *C07K 14/58* (2013.01); *C12N 9/16* (2013.01); *C12Y 301/03001* (2013.01); *C07K 2319/31* (2013.01)

(58) Field of Classification Search
CPC .. A61K 38/465; A61K 38/10; C07K 2319/31; C07K 7/08; C07K 14/58; C12Y 301/03001; C12N 9/16
See application file for complete search history.

(56) References Cited

U.S. PATENT DOCUMENTS

| | | | |
|---|---|---|---|
| 5,336,759 A | 8/1994 | Matsuo et al. | |
| 5,338,830 A | 8/1994 | Matsuo et al. | |
| 5,340,920 A | 8/1994 | Matsuo et al. | |
| 5,352,770 A | 10/1994 | Matsuo | |
| 5,428,130 A | 6/1995 | Capon et al. | |
| 5,434,133 A | 7/1995 | Tanaka et al. | |
| 5,583,108 A | 12/1996 | Wei et al. | |
| 5,665,704 A | 9/1997 | Lowe et al. | |
| 5,714,147 A | 2/1998 | Capon et al. | |
| 5,767,239 A | 6/1998 | Immer et al. | |
| 5,846,932 A | 12/1998 | Lowe et al. | |
| 5,948,761 A | 9/1999 | Seilhamer et al. | |
| 5,973,134 A | 10/1999 | Matsuo et al. | |
| 6,020,168 A | 2/2000 | Matsuo et al. | |
| 6,028,055 A | 2/2000 | Lowe et al. | |
| 6,034,231 A | 3/2000 | Tanaka et al. | |
| 6,290,952 B1 | 9/2001 | Poelstra et al. | |
| 6,406,697 B1 | 6/2002 | Capon et al. | |
| 6,407,211 B1 | 6/2002 | Burnett, Jr. et al. | |
| 6,420,384 B2 | 7/2002 | Weigele et al. | |
| 6,436,386 B1 | 8/2002 | Roberts et al. | |
| 6,455,495 B1 | 9/2002 | Orgel et al. | |
| 6,458,579 B2 | 10/2002 | Hopwood et al. | |
| 6,525,022 B1 | 2/2003 | Lowe et al. | |
| 6,541,610 B1 | 4/2003 | Smith | |
| 6,743,425 B2 | 6/2004 | Nakao | |
| 6,790,649 B1 | 9/2004 | Crine et al. | |
| 6,818,619 B2 | 11/2004 | Burnett, Jr. et al. | |
| 6,830,885 B1 | 12/2004 | Lanctot et al. | |
| 6,849,714 B1 | 2/2005 | Bridon et al. | |
| 6,887,470 B1 | 5/2005 | Bridon et al. | |

(Continued)

FOREIGN PATENT DOCUMENTS

| | | |
|---|---|---|
| EP | 0478797 B1 | 4/1995 |
| EP | 0769554 A2 | 4/1997 |

(Continued)

OTHER PUBLICATIONS

EBI Blast for Accession No. ATD17216. Entered Oct. 16, 2008 (1 page).
Supplementary European Search Report for European Patent Application No. 11853820.6, dated Mar. 25, 2014 (3 pages).
International Preliminary Report on Patentability for International Patent Application No. PCT/US2012/060869, dated Apr. 22, 2014 (7 pages).
International Preliminary Report on Patentability for International Patent Application No. PCT/US2012/039004, dated Apr. 22, 2014 (8 pages).
Siris et al., "Paget's disease of bone," Trends Endocrinol and Metab. 2(6):207-12 (1991).
European Search Report for European Patent Aplication No. 12842640.0, dated Mar. 13, 2015 (7 pages).
NCBI Protein Database Accession No. Q6PYX1. Retrieved on Oct. 15, 2013 (2 pages).

(Continued)

*Primary Examiner* — Gregory S Emch
(74) *Attorney, Agent, or Firm* — Clark & Elbing LLP

(57) ABSTRACT

The present invention provides methods, compositions, and kits for the treatment of neurocutaneous syndromes, such as neurofibromatosis type I; disorders associated with overactivation of FGFR3, such as achondroplasia; bone or cartilage disorders; or vascular smooth muscle disorders; or for the elongation of bone. In some embodiments, the present invention provides polypeptides having an alkaline phosphatase peptide fused to an Fc domain of an immunoglobulin or a natriuretic peptide fused to an Fc domain of an immunoglobulin. Such polypeptides can be administered to subjects, e.g., subcutaneously, to treat a neurocutaneous syndrome, a disorder associated with overactivation of FGFR3, a bone or cartilage disorder, or a vascular smooth muscle disorder, or to elongate bone. The invention also features nucleic acid molecules encoding such polypeptides and the use of the nucleic acid molecules for treating neurocutaneous syndromes, disorders associated with overactivation of FGFR3, bone or cartilage disorders, or vascular smooth muscle disorders, or for elongating bone.

17 Claims, 82 Drawing Sheets

(56) References Cited

U.S. PATENT DOCUMENTS

| | | |
|---|---|---|
| 6,905,689 B2 | 6/2005 | Schneidinger et al. |
| 6,946,484 B2 | 9/2005 | Adams et al. |
| 7,026,293 B2 | 4/2006 | Kitakaze |
| 7,033,997 B2 | 4/2006 | Forssmann et al. |
| 7,070,974 B1 | 7/2006 | Desgroseillers et al. |
| 7,105,539 B2 | 9/2006 | Gravel et al. |
| 7,179,903 B2 | 2/2007 | McArthur et al. |
| 7,256,253 B2 | 8/2007 | Bridon et al. |
| 7,271,149 B2 | 9/2007 | Glaesner et al. |
| 7,276,481 B2 | 10/2007 | Golembo et al. |
| 7,341,838 B2 | 3/2008 | Buechler et al. |
| 7,365,091 B2 | 4/2008 | Gravel et al. |
| 7,384,917 B2 | 6/2008 | Burnett, Jr. et al. |
| 7,399,466 B2 | 7/2008 | Boileau |
| 7,414,107 B2 | 8/2008 | Larsen |
| 7,425,531 B2 | 9/2008 | Lanctot et al. |
| 7,427,498 B2 | 9/2008 | Crine et al. |
| 7,470,668 B2 | 12/2008 | Lanctot et al. |
| 7,488,713 B2 | 2/2009 | Vesely |
| 7,527,939 B2 | 5/2009 | Davey et al. |
| 7,563,769 B2 | 7/2009 | Bogin et al. |
| 7,625,564 B2 | 12/2009 | Wang et al. |
| 7,642,243 B2 | 1/2010 | Nakao et al. |
| 7,648,962 B2 | 1/2010 | James et al. |
| 7,662,773 B2 | 2/2010 | James et al. |
| 7,678,391 B2 | 3/2010 | Graham et al. |
| 7,732,406 B2 | 6/2010 | Mitrovic et al. |
| 7,736,653 B2 | 6/2010 | Kim et al. |
| 7,754,852 B2 | 7/2010 | Burnett, Jr. et al. |
| 7,763,712 B2 | 7/2010 | Crine et al. |
| 7,803,769 B2 | 9/2010 | Sullivan et al. |
| 7,803,901 B2 | 9/2010 | Burnett, Jr. et al. |
| 7,825,092 B2 | 11/2010 | Vesely |
| 7,846,900 B2 | 12/2010 | Vesely |
| 7,858,560 B2 | 12/2010 | Koster et al. |
| 7,919,591 B2 | 4/2011 | Sheffer et al. |
| 7,943,126 B2 | 5/2011 | Tomatsu et al. |
| 7,960,529 B2 | 6/2011 | Crine et al. |
| 8,058,242 B2 | 11/2011 | Alewood et al. |
| 2002/0183276 A1 | 12/2002 | Millan et al. |
| 2003/0158132 A1 | 8/2003 | Kovesdi |
| 2004/0023916 A1 | 2/2004 | Millan et al. |
| 2004/0077537 A1 | 4/2004 | Schreiner |
| 2004/0234518 A1 | 11/2004 | Crine et al. |
| 2005/0113286 A1 | 5/2005 | Schreiner et al. |
| 2005/0142217 A1 | 6/2005 | Adams et al. |
| 2005/0202442 A1 | 9/2005 | Morris et al. |
| 2005/0244904 A1 | 11/2005 | Ng |
| 2005/0276796 A1 | 12/2005 | Tomatsu et al. |
| 2006/0014687 A1 | 1/2006 | Crine et al. |
| 2006/0019890 A1 | 1/2006 | Kapoun et al. |
| 2006/0074009 A1 | 4/2006 | James et al. |
| 2006/0110359 A1 | 5/2006 | Sanchez-Ramos et al. |
| 2006/0172929 A1 | 8/2006 | Rappold-Hoerbrand et al. |
| 2006/0228710 A1 | 10/2006 | Morris et al. |
| 2007/0041972 A1 | 2/2007 | Rother et al. |
| 2007/0042957 A1 | 2/2007 | Burnett et al. |
| 2007/0081984 A1 | 4/2007 | Tomatsu et al. |
| 2007/0081986 A1 | 4/2007 | Tomatsu et al. |
| 2007/0197434 A1 | 8/2007 | Nakao et al. |
| 2007/0281887 A1 | 12/2007 | Pan |
| 2007/0292966 A1 | 12/2007 | Prickett et al. |
| 2007/0293418 A1 | 12/2007 | Larsen |
| 2008/0032933 A1 | 2/2008 | Burnett et al. |
| 2008/0081768 A1 | 4/2008 | Watt et al. |
| 2008/0085862 A1 | 4/2008 | Kim et al. |
| 2008/0113411 A1 | 5/2008 | Sheffer et al. |
| 2008/0113412 A1 | 5/2008 | Sheffer et al. |
| 2008/0125574 A1 | 5/2008 | Sheffer et al. |
| 2008/0153747 A1 | 6/2008 | Alewood et al. |
| 2008/0161243 A1 | 7/2008 | Rosen et al. |
| 2008/0181903 A1 | 7/2008 | Bhaskar et al. |
| 2008/0182299 A1 | 7/2008 | Colocaru et al. |
| 2008/0194481 A1 | 8/2008 | Rosen et al. |
| 2008/0194682 A1 | 8/2008 | Golembo et al. |
| 2008/0227713 A1 | 9/2008 | Protter |
| 2008/0293632 A1 | 11/2008 | Rappold-Hoerbrand et al. |
| 2008/0312142 A1 | 12/2008 | Nakao et al. |
| 2009/0011997 A1 | 1/2009 | Peri et al. |
| 2009/0053192 A1 | 2/2009 | Millan et al. |
| 2009/0069243 A1 | 3/2009 | Burnett, Jr. et al. |
| 2009/0092582 A1 | 4/2009 | Bogin et al. |
| 2009/0142347 A1 | 6/2009 | Millan |
| 2009/0170756 A1 | 7/2009 | Burnett, Jr. et al. |
| 2009/0221803 A1 | 9/2009 | Dall'Acqua et al. |
| 2009/0238814 A1 | 9/2009 | Tomatsu et al. |
| 2009/0240031 A1 | 9/2009 | Immer et al. |
| 2009/0247462 A1 | 10/2009 | Bogin et al. |
| 2009/0252729 A1 | 10/2009 | Farrington et al. |
| 2009/0275506 A1 | 11/2009 | Bakis et al. |
| 2009/0325195 A1 | 12/2009 | Davey et al. |
| 2010/0008979 A1 | 1/2010 | Tomatsu et al. |
| 2010/0055150 A1 | 3/2010 | Golembo et al. |
| 2010/0160212 A1 | 6/2010 | Sheffer et al. |
| 2010/0168443 A1 | 7/2010 | Geysen |
| 2010/0184680 A1 | 7/2010 | Bevec |
| 2010/0197574 A1 | 8/2010 | Chen et al. |
| 2010/0204094 A1 | 8/2010 | Simari et al. |
| 2010/0204109 A1 | 8/2010 | Bevec |
| 2010/0204446 A1 | 8/2010 | Forssmann |
| 2010/0209958 A1 | 8/2010 | Nakao et al. |
| 2010/0216714 A1 | 8/2010 | James et al. |
| 2010/0221234 A1 | 9/2010 | Crine et al. |
| 2010/0240125 A1 | 9/2010 | Crine et al. |
| 2010/0249017 A1 | 9/2010 | Bevec et al. |
| 2010/0260706 A1 | 10/2010 | Bogin et al. |
| 2010/0261248 A1 | 10/2010 | Kim et al. |
| 2010/0297021 A1 | 11/2010 | Wendt et al. |
| 2010/0297119 A1 | 11/2010 | Crine et al. |
| 2010/0305031 A1 | 12/2010 | Wakabayashi et al. |
| 2010/0305051 A1 | 12/2010 | Burnett, Jr. et al. |
| 2010/0310561 A1 | 12/2010 | Canada et al. |
| 2010/0311660 A1 | 12/2010 | Simari et al. |
| 2010/0317600 A1 | 12/2010 | Immer et al. |
| 2010/0331256 A1 | 12/2010 | Wendt et al. |
| 2011/0152194 A1 | 6/2011 | Burnett, Jr. et al. |
| 2011/0250187 A1 | 10/2011 | Tomatsu et al. |
| 2011/0269684 A1 | 11/2011 | Burnett, Jr. et al. |

FOREIGN PATENT DOCUMENTS

| | | |
|---|---|---|
| EP | 0771875 B1 | 5/1997 |
| EP | 0466174 B1 | 6/1997 |
| EP | 0475394 B1 | 6/1997 |
| EP | 0466175 B1 | 1/1998 |
| EP | 0477971 B1 | 1/1998 |
| EP | 0475290 B1 | 12/1998 |
| EP | 0475291 B1 | 12/1998 |
| EP | 0497368 B1 | 6/2002 |
| EP | 1492567 | 9/2003 |
| EP | 1502604 A1 | 2/2005 |
| EP | 1623994 A2 | 2/2006 |
| EP | 1759001 | 3/2007 |
| EP | 1759710 A1 | 3/2007 |
| EP | 2158319 | 3/2010 |
| JP | 8070875 | 3/1996 |
| JP | 2000-327583 A | 11/2000 |
| JP | 2002-541776 A | 12/2002 |
| WO | WO-92/20371 A1 | 11/1992 |
| WO | WO-94/20534 A1 | 9/1994 |
| WO | WO-95/13296 A1 | 5/1995 |
| WO | WO-95/33769 A1 | 12/1995 |
| WO | WO-98/17690 A1 | 4/1998 |
| WO | WO-98/35703 A2 | 8/1998 |
| WO | WO-99/46283 A1 | 11/1999 |
| WO | WO-00/18954 A2 | 4/2000 |
| WO | WO-00/50580 A2 | 8/2000 |
| WO | WO-00/53755 A2 | 9/2000 |
| WO | WO-00/64486 A2 | 11/2000 |
| WO | WO-00/69900 A2 | 11/2000 |
| WO | WO-01/036620 A2 | 5/2001 |
| WO | WO-01/44284 A2 | 6/2001 |
| WO | WO-01/80890 A2 | 11/2001 |
| WO | WO-02/15918 A2 | 2/2002 |

(56) References Cited

FOREIGN PATENT DOCUMENTS

| | | |
|---|---|---|
| WO | WO-02/47871 A1 | 6/2002 |
| WO | WO-02/067639 A1 | 8/2002 |
| WO | WO-02/068579 A2 | 9/2002 |
| WO | WO-02/074234 A2 | 9/2002 |
| WO | WO-03/074082 A1 | 9/2003 |
| WO | WO-03/079979 A2 | 10/2003 |
| WO | WO-03/092581 A2 | 11/2003 |
| WO | WO-03/094835 A2 | 11/2003 |
| WO | WO-2004/011498 A2 | 2/2004 |
| WO | WO-2004/022579 A2 | 3/2004 |
| WO | WO-2004/046194 A2 | 6/2004 |
| WO | WO-2004/047871 A2 | 6/2004 |
| WO | WO-2004/062555 A2 | 7/2004 |
| WO | WO-2004/074320 A2 | 9/2004 |
| WO | WO-2004/094460 A2 | 11/2004 |
| WO | WO-2005/000095 A2 | 1/2005 |
| WO | WO-2005/007809 A2 | 1/2005 |
| WO | WO-2005/047337 A1 | 5/2005 |
| WO | WO-2005/070446 A1 | 8/2005 |
| WO | WO-2005/072055 A2 | 8/2005 |
| WO | WO-2005/094890 A1 | 10/2005 |
| WO | WO-2005/098490 A1 | 10/2005 |
| WO | WO-2005/103263 A1 | 11/2005 |
| WO | WO-2006/005140 A2 | 1/2006 |
| WO | WO-2006/026663 A9 | 3/2006 |
| WO | WO-2006/39480 A2 | 4/2006 |
| WO | WO-2006/060641 A2 | 6/2006 |
| WO | WO-2006/110743 A1 | 10/2006 |
| WO | WO-2006/116260 A2 | 11/2006 |
| WO | WO-2007/041645 A2 | 4/2007 |
| WO | WO-2007/097923 A2 | 8/2007 |
| WO | WO-2008/021872 A1 | 2/2008 |
| WO | WO-2008/030558 A2 | 3/2008 |
| WO | WO-2008/031045 A2 | 3/2008 |
| WO | WO-2008/058016 A2 | 5/2008 |
| WO | WO-2008/079995 A2 | 7/2008 |
| WO | WO-2008/109903 A1 | 9/2008 |
| WO | WO-2008/136611 A1 | 11/2008 |
| WO | WO-2008/138131 A1 | 11/2008 |
| WO | WO-2008/154226 A1 | 12/2008 |
| WO | WO-2009/006520 A1 | 1/2009 |
| WO | WO-2009/006732 A9 | 1/2009 |
| WO | WO-2009/015011 A1 | 1/2009 |
| WO | WO-2009/023270 A2 | 2/2009 |
| WO | WO-2009/033680 A2 | 3/2009 |
| WO | WO-2009/033724 A1 | 3/2009 |
| WO | WO-2009/033796 A1 | 3/2009 |
| WO | WO-2009/033807 A2 | 3/2009 |
| WO | WO-2009/034134 A2 | 3/2009 |
| WO | WO-2009/036448 A2 | 3/2009 |
| WO | WO-2009/040030 A1 | 4/2009 |
| WO | WO-2009/040031 A2 | 4/2009 |
| WO | WO-2009/040083 A2 | 4/2009 |
| WO | WO-2009/046861 A1 | 4/2009 |
| WO | WO-2009/058322 A1 | 5/2009 |
| WO | WO-2009/067639 A2 | 5/2009 |
| WO | WO-2009/086126 A2 | 7/2009 |
| WO | WO-2009/090553 A2 | 7/2009 |
| WO | WO 2009/142307 A1 | 11/2009 |
| WO | WO-2009/149161 A9 | 12/2009 |
| WO | WO-2009/156481 A1 | 12/2009 |
| WO | WO-2010/002583 A2 | 1/2010 |
| WO | WO-2010/011096 A2 | 1/2010 |
| WO | WO-2010/048308 A2 | 4/2010 |
| WO | WO-2010/078325 A2 | 7/2010 |
| WO | WO-2010/082804 A2 | 7/2010 |
| WO | WO-2010/117760 A2 | 10/2010 |
| WO | WO-2010/129655 A2 | 11/2010 |
| WO | WO-2010/135541 A2 | 11/2010 |
| WO | WO-2011/134084 A1 | 11/2011 |
| WO | WO-2012/099851 A2 | 7/2012 |
| WO | WO-2013/058833 A1 | 4/2013 |
| WO | WO-2013/059491 A1 | 4/2013 |

OTHER PUBLICATIONS

Oikawa et al., "Enzyme replacement therapy on hypophosphatasia mouse model," J Inherit Metab Dis. 1-9 (2013).

Yadav et al., "Dose response of bone-targeted enzyme replacement for murine hypophosphatasia," Bone. 49(2):250-6 (2011) (20 pages).

Extended European Search Report for European Application No. 11774253.6, dated Oct. 14, 2013 (8 pages).

Official Notification and Search Report for Eurasian Patent Application No. 201291138, dated May 17, 2013 (3 pages).

Achord et al., "Human β-glucuronidase: In vivo clearance and in vitro uptake by a glycoprotein recognition system on reticuloendothelial cells," Cell. 15:269-278 (1978).

Addison et al., "Pyrophosphate inhibits mineralization of osteoblast cultures by binding to mineral, up-regulating osteopontin, and inhibiting alkaline phosphate activity," J Biol Chem. 282(21):15872-15883 (2007).

Ali et al., "Isolation and characterization of calcifying matrix vesicles from epiphyseal cartilage," Proc Natl Acad Sci USA. 67(3):1513-1520 (1970).

Altarescu et al., "The efficacy of enzyme replacement therapy in patients with chronic neuronopathic Gaucher's disease," J Pediatr. 168(4):539-547 (2001).

Anderson et al., "The role of matrix vesicles in growth plate development and biomineralization," Front Biosci. 10:822-837 (2005).

Anderson et al., "Sustained osteomalacia of long bones despite major improvement in other hypophosphatasia-related mineral deficits in tissue nonspecific alkaline phosphatase/nucleotide pyrophosphatase phosphodiesterase 1 double-deficient mice," Am J Pathol. 166(6):1711-1720 (2005).

Anderson et al., "Pyrophosphate stimulation of calcium uptake into cultured embryonic bones. Fine structure of matrix vesicles and their role in calcification," Dev Biol. 34:211-227 (1973).

Anderson et al., "Impaired calcification around matrix vesicles of growth plate and bone in alkaline phosphatase-deficient mice," Am J Pathol. 164(3):841-847 (2004).

Anderson et al., "Matrix vesicles in osteomalacic hypophosphatasia bone contain apatite-like mineral crystals," Am J Pathol. 151(6):1555-1561 (1997).

Barranger et al., "Lessons learned from the development of enzyme therapy for Gaucher disease," J Inherit Metab Dis. 24(Supp 2):89-96 (2001).

Barton et al., "Replacement therapy for inherited enzyme deficiency—macrophage-targeted glucocerebrosidase for Gaucher's disease," N Engl J Med. 324(21):1464-1470 (1991) (Abstract only).

Beertsen et al., "Root development in mice lacking functional tissue non-specific alkaline phosphatase gene: Inhibition of acellular cementum formation," J Dent Res. 78(6):1221-1229 (1999).

Bennett et al., "Extracellular domain-IgG fusion proteins for three human natriuretic peptide receptors," J Biol Chem. 266(34):23060-23067 (1991).

Bernard, "Ultrastructural localization of alkaline phosphatase in initial intramembranous osteogenesis," Clin Orthop Relat Res. 135:218-225 (1978).

Bernardi et al., "Chromatography of proteins on hydoxyapatite," Methods Enzymol. 27:471-479 (1973).

Bobé et al., "Fas-mediated liver damage in MRL hemopoietic chimeras undergoing Ipr-mediated graft-versus-host disease," J Immunol. 159:4197-4204 (1997).

Bocciardi et al., "Overexpression of the C-type natriuretic peptide (CNP) is associated with overgrowth and bone anomalies in an individual with balanced t(2;7) translocation," Hum Mutat. 28(7):724-731 (2007).

Bonilla, "Pharmacokinetics of immunoglobulin administered via intravenous or subcutaneous routes," Immunol Allergy Clin N Am. 28:803-819 (2008).

Boskey, "Amorphous calcium phosphate: The contention of bone," J Dent Res. 76(8):1433-1436 (1997).

Boskey et al. "Matrix vesicles promote mineralization in a gelatin gel," Calcif Tissue Int. 60:309-315 (1997).

(56) References Cited

OTHER PUBLICATIONS

Brenner et al., "Diverse biological actions of atrial natriuretic peptide," Physiol Rev. 70(3):665-699 (1990).
Byers et al., "Effect of enzyme replacement therapy on bone formation in a feline model of mucopolysaccharidosis type VI," Bone. 21(5):425-431 (1997).
Cameron et al., "Minireview: Natriuretic peptides during development of the fetal heart and circulation," Endocrinology. 144(6):2191-2194 (2003).
Campbell et al., "Insulin-like growth factor (IGF)-binding protein-5-(201-218) region regulates hydroxyapatite and IGF-I binding," Am J Physiol. 273:E1005-1013 (1997).
Chen et al., "Gly369Cys mutation in mouse FGFR3 causes achondroplasia by affecting both chondrogenesis and osteogenesis," J Clin Invest. 104(11):1517-1525 (1999).
Choe et al., "Substrate profiling of cysteine proteases using a combinatorial peptide library identifies functionally unique specificities," J Biol Chem. 281(18):12824-12832 (2006).
Chusho et al., "Dwarfism and early death in mice lacking C-type natriuretic peptide," Proc Natl Acad Sci USA. 98(7):4016-4021 (2001).
Ciancaglini et al., "Contribution of matrix vesicles and alkaline phosphatase to ectopic bone formation," Braz J Med Biol Res. 39:603-610 (2006).
Cleland et al., "Emerging protein delivery methods," Curr Opin Biotechnol. 12:212-219 (2001).
Clemens et al., "Pharmacokinetics and biological actions of subcutaneously administered human brain natriuretic peptide," J Pharmacol Exp Ther. 287(1):67-71 (1998).
Crawley et al., "Enzyme replacement therapy in a feline model of Maroteaux-Lamy Syndrome," J Clin Invest. 97(8):1864-1873 (1996).
Daggubati et al., "Adrenomedullin, endothelin, neuropeptide Y, atrial, brain, and C-natriuretic prohormone peptides compared as early heart failure indicators," Cardiovasc Res. 36:246-255 (1997).
Data Sheet for pFUSE-SEAP-hFC "Plasmid designed for the expression of a SEAP-Fc Fusion protein," Invivogen, San Diego, CA (4 pages) (1989).
De Plater et al., "The natriuretic peptide (OVCNP-39) from platypus (*Ornithorhynchus anatinus*) venom relaxes the isolated rat uterus and promotes oedema and mast cell histamine release," Toxicon. 36(6):847-857 (1998).
Di Mauro et al., "Kinetic characterization of hypophosphatasia mutations with physiological substrates," J Bone Miner Res. 17(8):1383-1391 (2002).
Dumont et al., "Monomeric Fc fusions: impact on pharmacokinetic and biological activity of protein therapeutics," BioDrugs. 20(3):151-160 (2006).
Eng et al., "Safety and efficacy of recombinant human α-Galactosidase a replacement therapy in Fabry's Disease," N Engl J Med. 345(1):9-16 (2001).
Engel et al., "Characterization of the hormone binding site of natriuretic peptide receptor-C," FEBS Lett. 360:169-172 (1995).
Farley et al., "Effects of tunicamycin, mannosamine, and other inhibitors of glycoprotein processing on skeletal alkaline phosphatase in human osteoblast-like cells," Calcif Tissue Int. 76:63-74 (2005).
Farnum et al., "In vivo delivery of fluoresceinated dextrans to the murine growth plate: imaging of three vascular routes by multiphoton microscopy," Anat Rec A Discov Mol Cell Evol Biol. 288(1):91-103 (2006).
Fedde et al., "Alkaline phosphatase knock-out mice recapitulate the metabolic and skeletal defects of infantile hypophosphatasia," J Bone Miner Res. 14(12):2015-2026 (1999).
Fujisaki et al., "Osteotropic Drug Delivery System (ODDS) based on bisphosphonic prodrug. IV effects of osteotropic estradiol on bone mineral density and uterine weight in ovariectomized rats," J Drug Target. 5(2):129-138 (1997).
Fujisawa et al., "Acidic amino acid-rich sequences as binding sites of osteonectin to hydroxyapatite crystals," Biochim Biophys Acta. 1292:53-60 (1996).
Furbish et al., "Uptake and distribution of placental glucocerebrosidase in rat hepatic cells and effects of sequential deglycosylation," Biochim Biophys Acta. 673:425-434 (1981).
Furuya et al., "Structural requirements of C-type natriuretic peptide for elevation of cyclic GMP in cultured vascular smooth muscle cells," Biochem Biophys Res Commun. 183(3):964-969, 1992.
Garg, *Investigation of the role of FcRn in the absorption, distribution, and elimination of monoclonal antibodies*. Dissertation: State University of New York at Buffalo, 2007 (Abstract only) (2 pages).
Gilbert et al., "Chimeric peptides of statherin and osteopontin that bind hydroxyapatite and mediate cell adhesion," J Biol Chem. 275(21):16213-16218 (2000).
Greenberg et al., "A homoallelic $Gly^{317} \rightarrow$ Asp mutation in ALPL causes the perinatal (lethal) form of hypophosphatasia in Canadian mennonites," Genomics. 17:215-217 (1993).
Guo et al., "Protein tolerance to random amino acid change," Proc Natl Acad Sci USA. 101(25):9205-9210 (2004).
Hagiwara et al., "Autocrine regulation of rat chondrocyte proliferation by natriuretic peptide C and its receptor, natriuretic peptide receptor-B," J Biol Chem. 269(14):10729-10733, 1994.
Hagiwara et al., "cGMP produced in response to ANP and CNP regulates proliferation and differentiation of osteoblastic cells," Am J Physiol. 270:C1311-C1318 (1996).
Halling Linder et al., "Glycosylation differences contribute to distinct catalytic properties among bone alkaline phosphotase isoforms," Bone. 45(5):987-993 (2009).
Hardy et al., "Dissection of a carboxy-terminal region of the yeast regulatory protein RAP1 with effects on both transcriptional activation and silencing," Mol Cell Biol. 12(3):1209-1217 (1992).
Harmey et al., "Elevated skeletal osteopontin levels contribute to the hypophosphatasia phenotype in $Akp2^{-/-}$ mice," J Bone Miner Res. 21(9):1377-1386 (2006).
Harmey et al., "Concerted regulation of inorganic pyrophosphate and osteopontin by Akp2, Enpp1, and Ank," Am J Pathol. 164(4):1199-1209 (2004).
Hawrylak et al., "The solubilization of tetrameric alkaline phosphatase from human liver and its conversion into various forms by phosphatidylinositol phospholipase C or proteolysis," J Biol Chem. 263(28):14368-14373 (1988).
Henthorn et al., "Different missense mutations at the tissue-nonspecific alkaline phosphatase gene locus in autosomal recessively inherited forms of mild and severe hypophosphatasia," Proc Natl Acad Sci USA. 89:9924-9928 (1992).
Henthorn et al., "Missense mutations of the tissue non-specific alkaline phosphatase gene in hypophosphatasia," Clin Chem. 38(12):2501-2505 (1992).
Hessle et al., "Tissue-nonspecific alkaline phosphatase and plasma cell membrane glucoprotein-1 are central antagonistic regulators of bone mineralization," Proc Natl Acad Sci USA. 99(14): 9445-9449 (2002).
Horton et al., "Achondroplasia," Lancet. 370:162-172, 2007.
Hosain et al., "Targeted delivery of antineoplastic agent to bone: biodistribution studies of technetium-99m-labeled gem-bisphosphonate conjugate of methotrexate," J Nucl Med. 37(1):105-107 (1996).
Hult et al., "Engineered enzymes for improved organic synthesis," Curr Opin Biotechnol. 14:395-400 (2003).
Hunter et al., "Modulation of crystal formation by bone phosphoproteins: structural specificity of the osteopontin-mediated inhibition of hydroxyapatite formation," Biochem J. 300:723-728 (1994).
Husain et al., "Fc site-specific labeling of immunoglobulins with calf intestinal alkaline phosphatase," Bioconjug Chem. 5(5):482-490 (1994).
Ikezawa, "Glycosylphosphatidylinositol (GPI)-anchored proteins," Biol Pharm Bull. 25(4):409-417 (2002).
Inoue et al., "Four functionally distinct C-type natriuretic peptides found in fish reveal evolutionary history of the natriuretic peptide system," Proc Natl Acad Sci USA. 100(17):10079-10084 (2003).
Jansonius, "Structure, evolution and action of vitamin $B_6$-dependent enzymes," Curr Opin Struct Biol. 8:759-769 (1998).

(56) References Cited

OTHER PUBLICATIONS

Jin et al., "Novel analog of atrial natriuretic peptide selective for receptor-A produces increased diuresis and natriuresis in rats," J Clin Invest. 98(4):969-976 (1996).
Johnson et al., "Matrix vesicle plasma cell membrane glycoprotein-1 regulates mineralization by murine osteoblastic MC3T3 cells," J Bone Miner Res. 14(6):883-892 (1999).
Kakkis et al., "Enzyme-replacement therapy in mucopolysaccharidosis I," N Engl J Med. 344(3):182-188 (2001).
Kalra et al., "The role of C-type natriuretic peptide in cardiovascular medicine," Eur Heart J. 22:997-1007 (2001).
Kasugai et al., "Selective drug delivery system to bone: small peptide $(Asp)_6$conjugation," J Bone Miner Res. 15(5):936-943 (2000).
Kaufmann et al., "Influence of low temperature on productivity, proteome and protein phosphorylation of CHO cells," Biotechnol Bioeng. 63(5):573-582 (1999).
Kochendoerfer, "Protein & peptide drug delivery—third international conference: Minimally invasive delivery methods," IDrugs. 6(11):1043-1045 (2003).
Kostenuik et al., "Infrequent delivery of a long-acting PTH-Fc fusion protein has potent anabolic effects on cortical and cancellous bone," J Bone Miner Res. 22(10):1534-1547 (2007).
Leone et al., "Allosteric modulation of pyrophosphatase activity of rat osseous plate alkaline phosphatase by magnesium ions," Int J Biochem Cell Biol. 30:89-97 (1998).
Lo et al., "High level expression and secretion of Fc-X fusion proteins in mammalian cells," Protein Eng. 11(6):495-500 (1998).
Mahmood et al., "Selection of the first-time dose in humans: comparison of different approaches based on interspecies scaling of clearance," J Clin Pharmacol. 43:692-697 (2003).
Mayer, "Immunoglobulins: structure and function, microbiology and immunology on-line," <http://pathmicro.med.sc.edu/mayer/IgStruct2000.htm>, University of South Carolina School of Medicine, 12 pages (2009).
Mericq et al., "Regulation of fetal rat bone growth by C-type natriuretic peptide and cGMP," Pediatr Res. 47:189-193 (2000).
Meyer, "Can biological calcification occur in the presence of pyrophosphate?" Arch Biochem Biophys. 231:1-8 (1984).
Michigami et al., "Common mutations F310L and T1559del in the tissue-nonspecific alkaline phosphatase gene are related to distinct phenotypes in Japanese patients with hypophosphatasia," Eur J Pediatr. 164:277-282 (2005).
Millan, "Mammalian Alkaline Phosphatases," Wiley-WCH Verlag GmbH & Co., Weinheim, Germany, 1-322 (2006).
Millán et al., "Enzyme replacement therapy for murine hypophosphatasia." J Bone Miner Res. 23(6): 777-787 (2008) (Epublished ahead of print on Dec. 17, 2007).
Miyazawa et al., "Cyclic GMP-dependent protein kinase II plays a critical role in C-type natriuretic peptide-mediated endochondral ossification," Endocrinology. 143(9):3604-3610 (2002).
Morris et al., "Immunolocalization of alkaline phosphatase in osteoblasts and matrix vesicles of human fetal bone," Bone Miner. 19:287-298 (1992).
Moss et al., "Association of inorganic-pyrophosphatase activity with human alkaline-phosphatase preparations," Biochem J. 102:53-57 (1967).
Murray, "Lectin-specific targeting of lysosomal enzymes to reticuloendothelial cells," Methods Enzymol. 149:25-42 (1987).
Murshed et al., "Unique coexpression in osteoblasts of broadly expressed genes accounts for the spatial restriction of ECM mineralization to bone," Genes Dev. 19:1093-1104 (2005).
Nakao et al., "The pharmacokinetics of α-human atrial natriuretic polypeptide in healthy subjects," Eur J Clin Pharmacol. 31:101-103 (1986).
Narisawa et al., "Abnormal vitamin B6 metabolism in alkaline phosphatase knock-out mice causes multiple abnormalities, but not the impaired bone mineralization," J Pathol. 193:125-133 (2001).

Narisawa et al., "Inactivation of two mouse alkaline phosphatase genes and establishment of a model of infantile hypophosphatasia," Dev Dyn. 208:432-446 (1997).
Nasu et al., "Aberrant interchain disulfide bridge of tissue-nonspecific alkaline phosphatase with an Arg433 → Cys substitution associated with severe hypophosphatasia," FEBS Journal. 273:5612-5624 (2006).
NCBI Protein Database Accession No. AAF64516. Retrieved on Apr. 16, 2013 (2 pages).
NCBI Protein Database Accession No. AAC33858. Retrieved on Apr. 16, 2013 (1 page).
NCBI Protein Database Accession No. AAH21289. Retrieved on Apr. 16, 2013 (2 pages).
NCBI Protein Database Accession No. AAH66116. Retrieved on Apr. 16, 2013 (2 pages).
NCBI Protein Database Accession No. AAH90861. Retrieved on Apr. 16, 2013 (2 pages).
NCBI Protein Database Accession No. AAI10910. Retrieved on Apr. 16, 2013 (2 pages).
NCBI Protein Database Accession No. AAI18209. Retrieved on Apr. 17, 2013 (2 pages).
NCBI Protein Database Accession No. AAI26166. Retrieved on Apr. 16, 2013 (2 pages).
NCBI Protein Database Accession No. AAN64273. Retrieved on Apr. 16, 2013 (1 page).
NCBI Protein Database Accession No. NP_000469. Retrieved on Apr. 16, 2013 (2 pages).
NCBI Protein Database Accession No. NP_001036028. Retrieved on Apr. 16, 2013 (2 pages).
NCBI Protein Database Accession No. NP_001253798, downloaded on Apr. 17, 2013.
NCBI Protein Database Accession No. NP_001622, donwloaded on Apr. 16, 2013.
NCBI Protein Database Accession No. NP_001623. Retrieved on Apr. 16, 2013 (3 pages).
NCBI Protein Database Accession No. NP_031457, donwloaded on Apr. 16, 2013.
NCBI Protein Database Accession No. NP_037191, donwloaded on Apr. 16, 2013.
NCBI Protein Database Accession No. NP_112603. Retrieved on Apr. 16, 2013 (3 pages).
NCBI Protein Database Accession No. NP_776412, donwloaded on Apr. 17, 2013.
NCBI Protein Database Accession No. NP_789828, donwloaded on Apr. 16, 2013.
NCBI Protein Database Accession No. P01857, donwloaded on Apr. 18, 2013.
NCBI Protein Database Accession No. P05186. Retrieved on Apr. 16, 2013 (19 pages).
NCBI Protein Database Accession No. P05187. Retrieved on Apr. 16, 2013 (10 pages).
NCBI Protein Database Accession No. P08289. Retrieved on Apr. 16, 2013 (5 pages).
NCBI Protein Database Accession No. P09242. Retrieved on Apr. 16, 2013 (6 pages).
NCBI Protein Database Accession No. P09487. Retrieved on Apr. 16, 2013 (4 pages).
NCBI Protein Database Accession No. P09923. Retrieved on Apr. 16, 2013 (6 pages).
NCBI Protein Database Accession No. P10696. Retrieved on Apr. 16, 2013 (7 pages).
NCBI Protein Database Accession No. Q29486. Retrieved on Apr. 16, 2013 (3 pages).
NCBI Protein Database Accession No. Q9N0V0. Retrieved on Apr. 16, 2013 (1 page).
NCBI Protein Database Accession No. XP-001109717. Retrieved on Apr. 17, 2013.
Ngo et al., Computational complexity, protein structure prediction, and the levinthal paradox. *The Protein Folding Problem and Tertiary Structure Prediction*. Merz et al. (ed.), 433, 492-495 (1994).
Nishioka et al., "Enhancement of drug delivery to bone: characterization of human tissue-nonspecific alkaline phosphatase tagged with an acidic oligopeptide," Mol Genet Metab. 88:244-255 (2006).

(56) References Cited

OTHER PUBLICATIONS

Nosjean et al., "Human tissue non-specific alkaline phosphatases: sugar-moiety-induced enzymic and antigenic modulations and genetic aspects," Biochem J. 321:297-303 (1997).

Oda et al., "A general method for rapid purification of soluble versions of glycosylphosphatidylinositol-anchored proteins expressed in insect cells: an application for human tissue-nonspecific alkaline phosphatase," J Biochem. 126(4):694-699 (1999).

Patti et al., "Critical residues in the ligand-binding site of the *staphylococcus aureus* collagen-binding adhesin (MSCRAMM)," J Biol Chem. 270(20):12005-12011 (1995).

Pedersen et al., "Removal of N-terminal polyhistidine tags from recombinant proteins using engineered aminopeptidases," Prot Expr Purifi. 15:389-400 (1999).

Pfeifer et al., "Intestinal secretory defects and dwarfism in mice lacking cGMP-dependent protein kinase II," Science. 274:2082-2086 (1996).

Potter et al., "Natriuretic peptides, their receptors, and cyclic guanosine monophosphate-dependent signaling functions," Endocr Rev. 27(1):47-72 (2006).

Ramachandran et al., "Treatment of an anabolic bone deficiency in neurofibromatosis with bone morphogenetic proteins and its potential application for congenital pseudarthrosis of the tibia," J Bone Joint Surg Br. 91-B (Suppl. 1), Abstract 137 (2009).

Rezende et al., "Inorganic pyrophosphate-phosphohydrolytic activity associated with rat osseous plate alkaline phosphatase," Cell Mol Biol. 44(2):293-302 (1998).

Rowe et al., "MEPE, a new gene expressed in bone marrow and tumors causing osteomalacia," Genomics. 67:54-68 (2000).

Russell et al., "Inorganic pyrophosphate in plasma in normal persons and in patients with hypophosphatasia, osteogenesis imperfecta, and other disorders of bone," J Clin Invest. 50:961-969 (1971).

Salih et al., "Identification of the phosphorylated sites of metabolically $_{32}$P-labeled osteopontin from cultured chicken osteoblasts," J Biol Chem. 272(21):13966-13973 (1997).

Sands et al., "Enzyme replacement therapy for murine mucopolysaccharidosis type VII," J Clin Invest. 93:2324-2331 (1994).

Sekido et al., "Novel drug delivery system to bone using acidic oligopeptide: pharmacokinetic characteristics and pharmacological potential," J Drug Target. 9(2):111-121 (2001).

Sharom et al., "Glycosylphosphatidylinositol-anchored proteins: structure, function, and cleavage by phosphatidylinositol-specific phospholipase C," Biochem Cell Biol. 80:535-549 (2002).

Spears et al., "Deoxyuridylate effects on thymidylate synthase-5-fluorodeoxyuridylate-folate ternary complex formation," Biochem Pharmacol. 38(18):2985-2993 (1989).

Srinivas et al., "Assessment of dose proportionality, absolute bioavailability, and immunogenicity response of CTLA4lg (BMS-188667), a novel immunosuppressive agent, following subcutaneous and intravenous administration to rats," Pharm Res. 14(7):911-916 (1997).

Stahl et al., "Evidence for receptor-mediated binding of glycoproteins, glycoconjugates, and lysosomal glycosidases by alveolar macrophages," Proc Natl Acad Sci USA. 75(3):1399-1403 (1978).

Sturtz et al., "A study of the delivery-targeting concept applied to antineoplasic drugs active on human osteosarcoma. I. Synthesis and biological activity in nude mice carrying human osteosarcoma xenografts of gem-bisphosphonic methotrexate analogues," Eur J Med Chem. 27:825-833 (1992).

Suda et al., "C-type natriuretic peptide as an autocrine/paracrine regulator of osteoblast: evidence for possible presence of bone natriuretic peptide system," Biochem Biophys Res Commun. 223:1-6 (1996).

Shukla et al., "RNA interference and inhibition of MEK-ERK signaling prevent abnormal skeletal phenotypes in a mouse model of craniosynostosis," Nat Genet. 39(9):1145-1150 (2007).

Shull et al., "Enzyme replacement in a canine model of Hurler syndrome," Proc Natl Acad Sci USA. 91(26):12937-12941 (1994).

Symersky et al., "Structure of the collagen-binding domain from a *Staphylococcus aureus* adhesin," Nat Struct Biol. 4(10):833-838 (1997).

Takano et al., "Molecular evolution of shark C-type natriuretic peptides," Zoolog Sci. 11:451-454 (1994).

Tamura et al., "Critical roles of the guanylyl cyclase B receptor in endochondral ossification and development of female reproductive organs," Proc Natl Acad Sci USA. 101(49):17300-17305 (2004).

Teixeira et al., "Nitric oxide, C-type natriuretic peptide and cGMP as regulators of endochondral ossification," Dev Biol. 319:171-178 (2008).

Tsuji et al., "A loss-of-function mutation in natriuretic peptide receptor 2 (Npr2) gene is responsible for disproportionate dwarfism in cn/cn mouse," J Biol Chem. 280(14):14288-14292 (2005).

Tye et al., "Delineation of the hydroxyapatite-nucleating domains of bone sialoprotein," J Biol Chem. 278(10):7949-7955 (2003).

Uludag et al., "Bone affinity of a bisphosphonate-conjugated protein in vivo," Biotechnol Prog. 16:1115-1118 (2000).

Urlaub et al., "Deletion of the diploid dihydrofolate reductase locus from cultured mammalian cells," Cell. 33:405-412 (1983).

Wang et al., "A mouse model for achondroplasia produced by targeting fibroblast growth factor receptor 3," Proc Natl Acad Sci USA. 96:4455-4460 (1999).

Wang et al., "Mice lacking Nf1 in osteochondroprogenitor cells display skeletal dysplasia similar to patients with neurofibromatosis type 1," Hum Mol Genet. 20(20):3910-3924 (2011).

Wang et al., "Structure-based chemical modification strategy for enzyme replacement treatment of phenylketonuria," Mol Genet Metab. 86:134-140 (2005).

Waymire et al., "Mice lacking tissue non-specific alkaline phosphatase die from seizures due to defective metabolism of vitamin B-6," Nat Genet. 11:45-51 (1995).

Weinberg, "An overview of infliximab, etanercept, efalizumab, and alefacept as biologic therapy for psoriasis," Clin Ther. 25(10):2487-2505 (2003).

Weiss et al., "A missense mutation in the human liver/bone/kidney alkaline phosphatase gene causing a lethal form of hypophosphatasia," Proc Natl Acad Sci USA. 85:7666-7669 (1988).

Weiss et al., "Isolation and characterization of a cDNA encoding a human liver/bone/kidney-type alkaline phosphatase," Proc Natl Acad Sci USA. 83:7182-7186 (1986).

Weiss et al., "Structure of the human liver/bone/kidney alkaline phosphatase gene," J Biol Chem. 263(24):12002-12010 (1988).

Weninger et al., "Biochemical and morphological effects of human hepatic alkaline phosphatase in a neonate with hypophosphatasia," Acta Paediatr Scand. Suppl. 360:154-160 (1989).

Whyte et al., "Enzyme-replacement therapy in life-threatening hypophosphatasia," N Engl J Med. 366(10):904-913 (2012).

Whyte et al., "Markedly increased circulating pyridoxal-5'-phosphate levels in hypophosphatasia," J Clin Invest. 76:752-756 (1985).

Whyte. Hypophosphatasia: nature's window on alkaline phosphatase function in man. *Principles of Bone Biology*. JJ Bilezikian, LG Raisz, and GA Rodan. London: Academic Press,1229-1248 (2002).

Whyte, "Hypophosphatasia," *The Metabolic and Molecular Bases of Inherited Disease* (8th ed.), pp. 5313-5329 (2001) (McGraw-Hill Book Company) (epub pp. 1-41).

Whyte et al., Heritable forms of rickets and osteomalacia. *Connective Tissues and Its Heritable Disorders*, Royce and Steinmann, Wiley-Liss, 765-787 (2002).

Whyte et al., "Marrow cell transplantation for infantile hypophosphatasia," J Bone Miner Res. 18:624-636 (2003).

Whyte et al., "Infantile hypophosphatasia: normalization of circulating bone alkaline phosphatase activity followed by skeletal remineralization. Evidence for an intact structural gene for tissue nonspecific alkaline phosphatase," J Pediatr. 108(1):82-88 (1986).

Whyte et al., "Infantile hypophosphatasia: enzyme replacement therapy by intravenous infusion of alkaline phosphatase-rich plasma from patients with Paget bone disease," J Pediatr. 101(3):379-386 (1982).

(56) References Cited

OTHER PUBLICATIONS

Whyte et al., "Enzyme replacement therapy for infantile hypophosphatasia attempted by intravenous infusions of alkaline phosphatase-rich plasma from patients with Paget bone disease. Results in three additional patients," J Pediatr. 105(6):926-933 (1984).
Whyte et al., "Alkaline phosphatase: placental and tissue non-specific isoenzymes hydrolyze phosphoethanolamine, inorganic pyrophosphate, and pyridoxal 5'-phosphate," J Clin Invest. 95:1440-1445 (1995).
Whyte, "Hypophosphatasia and the role of alkaline phosphatase in skeletal mineralization," Endocr Rev. 15(4):439-461 (1994).
Williams et al., "Solute transport in growth plate cartilage: In vitro and in vivo," Biophys J. 93(3):1039-1050 (2007).
Wroblewski et al., "Pharmacokinetics, metabolic stability, and subcutaneous bioavailability of a genetically engineered analog of DcR3, flint [DcR3(R218Q)], in cynomolgus monkeys and mice," Drug Metab Dispos. 31(4):502-507 (2003).
Yamamoto et al., "Long term phenotypic correction of severe infantile hypophosphatasia in a mouse model by neonatal injection of lentiviral vector," Mol Therapy. 17(Suppl. 1):S67-S68 (2009).
Yamamoto et al., "Prolonged survival and phenotypic correction of Akp2$^{-/-}$ hypophosphatasia mice by lentiviral gene therapy," J Bone Miner Res. 26(1):135-142 (2011).
Yasoda et al., "Natriuretic peptide regulation of endochondral ossification. Evidence for possible roles of the C-type natriuretic peptide/guanylyl cyclase-B pathway," J Biol Chem. 273(19):11695-11700 (1998).
Yasoda et al., "Overexpression of CNP in chondrocytes rescues achondroplasia through a MAPK-dependent pathway," Nat Med. 10(1):80-86, 2004.
Yasoda et al., "Systemic administration of C-type natriuretic peptide as a novel therapeutic strategy for skeletal dysplasias," Endocrinology. 150(7):3138-3144 (2009).
Yoder et al., "Reduced ability of C-type natriuretic peptide (CNP) to activate natriuretic peptide receptor B (NPR-B) causes dwarfism in Ibab −/− mice," Peptides. 29:1575-1581 (2008).
Yokogawa et al., "Selective delivery of estradiol to bone by aspartic acid oligopeptide and its effects on ovariectomized mice," Endocrinology. 142(3):1228-1233 (2001).
Young et al., "Structure, expression, and regulation of the major noncollagenous matrix proteins of bone," Clin Orthop Relat Res. 281:275-294 (1992).
Zierhut et al., "Population PK-PD model for Fc-osteoprotegerin in healthy postmenopausal women," J Pharmacokinet Pharmacodyn. 35:379-399 (2008).
Zurutuza et al., "Correlations of genotype and phenotype in hypophosphatasia," Hum Mol Genet. 8(6):1039-1046 (1999).
International Search Report for International Patent Application No. PCT/US2012/060869, dated Mar. 25, 2013 (5 pages).
Restriction Requirement for U.S. Appl. No. 12/599,679, dated Jun. 12, 2012 (5 pages).
Invitation to Pay Additional Fees for International Application No. PCT/CA2011/050807, dated Feb. 13, 2012 (2 pages).
Communication from Examining Division for European Application No. EP 05 739 065.0, dated Jun. 11, 2010 (5 pages).
Office Action for U.S. Appl. No. 11/484,870, dated Jan. 25, 2007 (15 pages).
Office Action for U.S. Appl. No. 11/484,870, dated Aug. 11, 2009 (15 pages).
Office Action for U.S. Appl. No. 11/484,870, dated Jul. 5, 2007 (13 pages).
Office Action for U.S. Appl. No. 11/484,870, dated Oct. 1, 2007 (12 pages).
Office Action for U.S. Appl. No. 11/484,870, dated Jun. 25, 2008 (16 pages).
Office Action for U.S. Appl. No. 11/484,870, dated Feb. 2, 2009 (16 pages).
Office Action for U.S. Appl. No. 11/111,664, dated Oct. 4, 2007 (11 pages).
Office Action for U.S. Appl. No. 11/111,664, dated May 14, 2008 (8 pages).
Office Action for U.S. Appl. No. 11/111,664, dated Dec. 4, 2008 (7 pages).
Reply to Office Action for U.S. Appl. No. 11/111,664, dated Sep. 10, 2008 (32 pages).
Office Action for U.S. Appl. No. 12/405,920, dated Aug. 9, 2010 (7 pages).
Office Action for U.S. Appl. No. 12/405,920, dated Dec. 17, 2009 (14 pages).
Office Action for U.S. Appl. No. 12/793,517, dated Aug. 16, 2010 (16 pages).
Advisory Action for U.S. Appl. No. 11/484,870, dated Dec. 20, 2007 (4 pages).
International Search Report and Written Opinion for International Application No. PCT/CA2005/000615, dated Aug. 18, 2005 (14 pages).
International Search Report and Written Opinion for International Application No. PCT/CA2008/000923, dated Sep. 12, 2008 (11 pages).
Communication from Examining Division for European Application No. EP 05 739 065.0, dated Jun. 18, 2009 (11 pages).
Supplementary European Search Report for European Application No. EP 05739065, date of completion Nov. 7, 2008 (2 pages).
Supplementary European Search Report for EP08757088 dated Jun. 21, 2010 (7 pages).
Declaration of Dr. Philippe Crine for EP 08757088.3, executed Jan. 14, 2011 (6 pages).
International Preliminary Report on Patentability and Written Opinion for International Application No. PCT/CA2011/050258, dated Nov. 15, 2012 (9 pages).
International Search Report and Written Opinion for International Application No. PCT/US12/39004, dated Nov. 2, 2012 (22 pages).
International Search Report and Writen Opinion for International Applicaiton No. PCT/CA2011/050807, dated Apr. 13, 2012 (18 pages).
Invitation to Pay Additional Fees for International Application No. PCT/US12/39004, dated Aug. 29, 2012 (2 pages).
European Search Report for European Application No. EP08757088, dated Jun. 21, 2010 (6 pages).
Communication from Examining Division for European Application No. EP 08 757 088, dated Apr. 20, 2011 (4 pages).
Extended European Search Report for European Application No. EP 11 00 0196, dated Jun. 22, 2011 (6 pages).
Extended European Search Report for European Application No. EP 11 00 4496, dated Aug. 26, 2011 (7 pages).
International Search Report and Written Opinion for International Application No. PCT/CA2011/050258, dated Jul. 29, 2011 (14 pages).
Tomatsu, Declaration Under 37 C.F.R. § 1.132 for U.S. Appl. No. 11/484,870, dated Nov. 27, 2007 (2 pages).
Tomatsu, Declaration Under 37 C.F.R. § 1.132 for U.S. Appl. No. 11/484,870, dated Jun. 1, 2009 (3 pages).
Lee et al., "Disturbed osteoblastic differentiation of fibrous hamartoma cell from congenital pseudarthrosis of the tibia associated with neurofibromatosis type I," Clin Orthop Surg. 3(3):230-7 (2011).
Schindeler et al., "Modeling bone morphogenetic protein and bisphosphonate combination therapy in wild-type and Nf1 haploinsufficient mice," J Orthop Res. 26(1):65-74 (2008).

$Nf1_{col2}^{-/-}$ Osteoblasts Secrete Increased Levels of Pyrophosphate ($PP_i$)

Increased *Ank* Expression in $Nf1_{col2}^{-/-}$ Osteoblasts

Hypothetical Working Model for Defective Bone Matrix Mineralization in NF1$_{col2}$$^{-/-}$ Mice

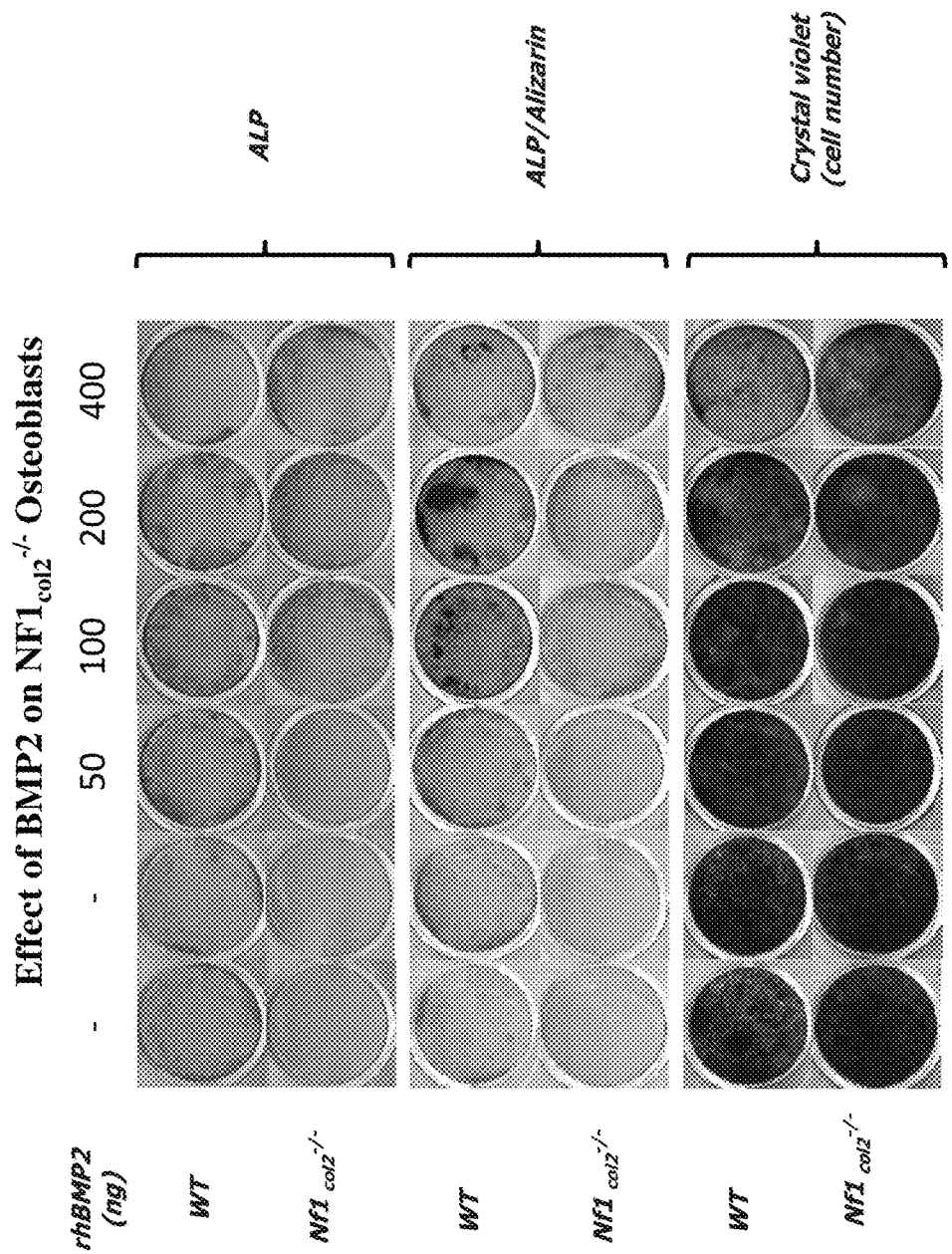
FIG. 3A Effect of BMP2 on NF1$_{col2}^{-/-}$ Osteoblasts

Effect of sTNALP-FcD$_{10}$ on NF1$_{col2}^{-/-}$ Bone Marrow Stromal Cells

Effect of sTNALP-FcD$_{10}$ on NF1$_{col2}$$^{-/-}$ Bone Marrow Stromal Cells

Effect of sTNALP-FcD$_{10}$ on Floxed NF1$_{col2}$$^{-/-}$ Bone Marrow Stromal Cells Effect of sTNALP-FcD$_{10}$ on Bone Volume in NF1$_{col2}^{-/-}$ Mice Expression of *NPR-B* Gene in $Nf1_{col2}^{-/-}$ Mice Effect of NC2-KGANKK on NF1$_{col2}$-/- Chondrocytes

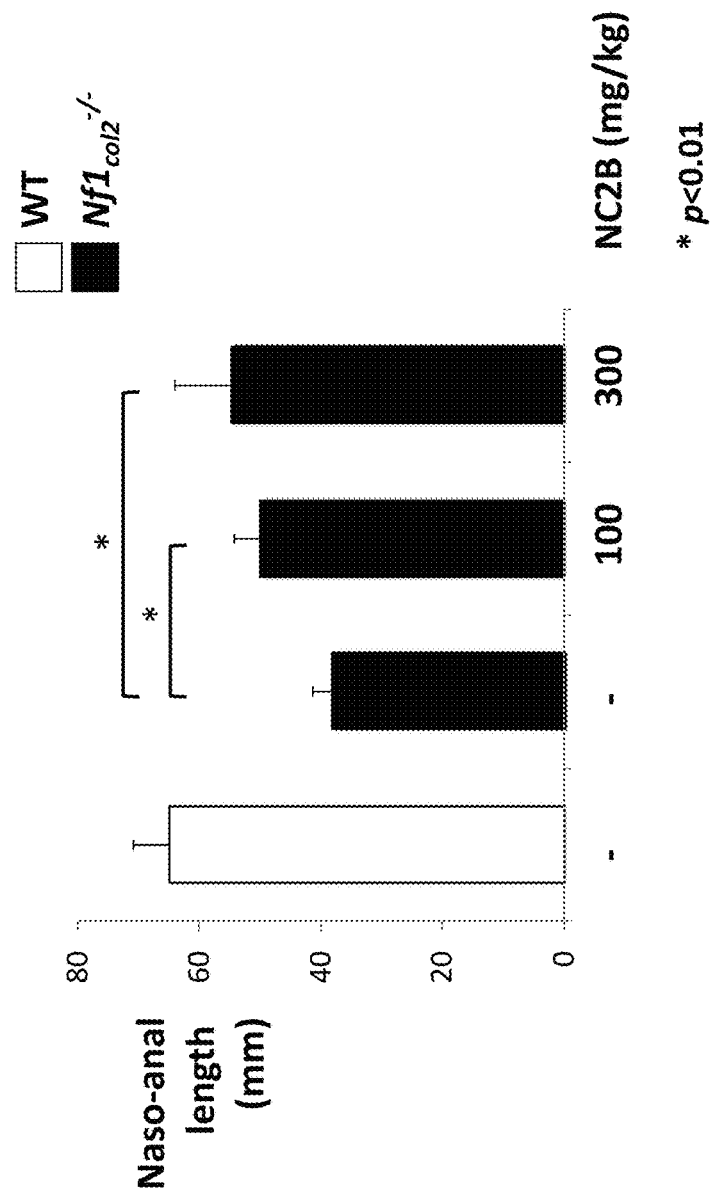

Effect of NC2B on Tibia Length in $NF1_{col2}^{-/-}$ Mice

FIG. 4E
Effect of NC2B on Growth Plates in NF1$_{col2}$-/- Mice
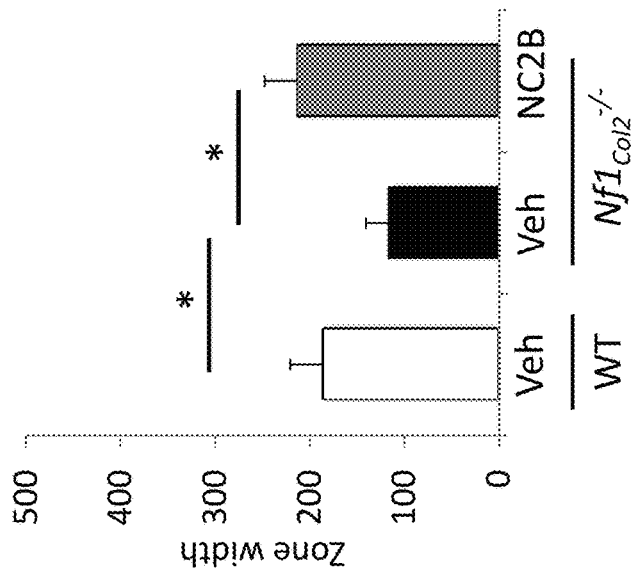
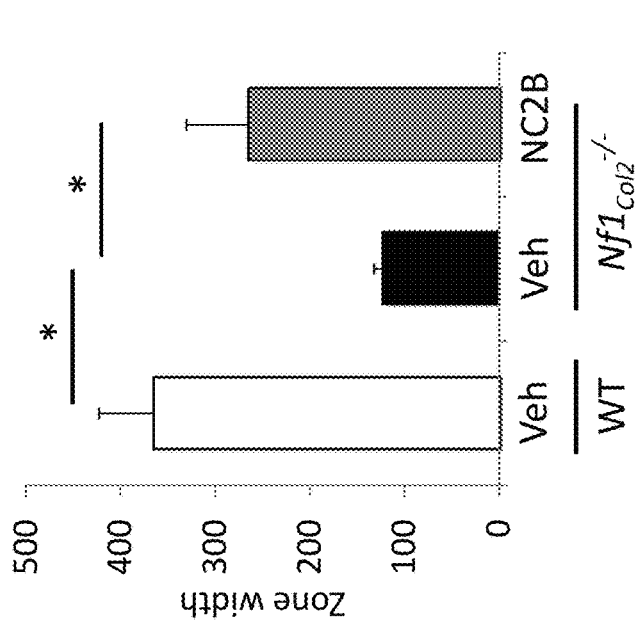
*; $p<0.01$, n=3

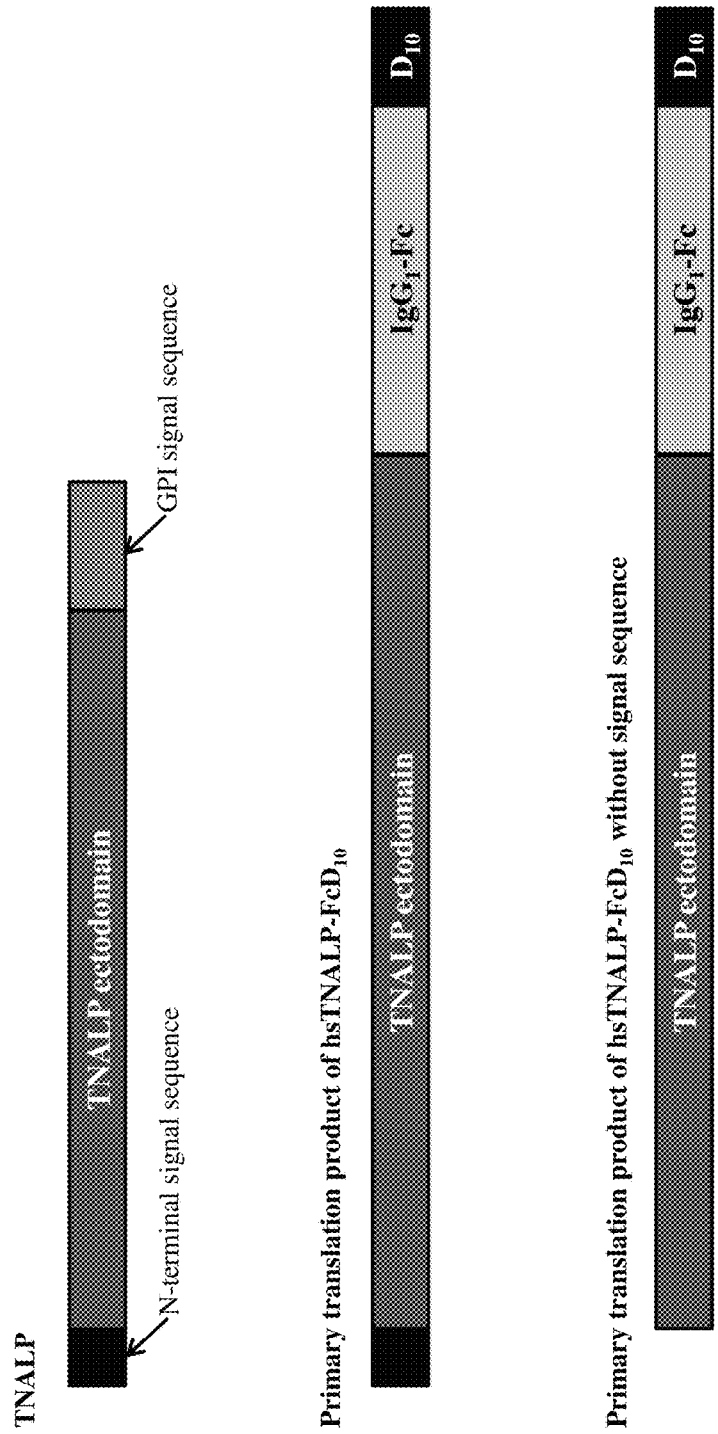

FIG. 5B hsTNALP-FcD₁₀ Protein Sequence
(With and Without Signal Sequence)

```
sTNALP-FcD10    MVSPFLVLAIGTCLTNSLVPEKEKDPKYWRDQAQETLKYALELQKLNTNVAKNVIMFLGDGMGVSTVTAA
(w/sig. seq.)   RILKGQLHHNPGEETRLEMDKFPFVALSKTYNTNAQVPDSAGTATAYLCGVKANEGTVGVSAATERSRCN
                TTQGNEVTSILRWAKDAGKSVGIVTTTRVNHATPSAAYAHSADRDWYSDNEMPPEALSQGCKDIAYQLMH
                NIRDIDVIMGGGRKYMYPKNKTDVEYESDEKARGTRLDGLDLVDTWKSFKPRYKHSHFIWNRTELLTLDP
                HNVDYLLGLFEPGDMQYELNRNNVTDPSLSEMVVVAIQILRKNPKGFFLLVEGGRIDHGHHEGKAKQALH
                EAVEMDRAIGQAGSLTSSEDTLTVVTADHSHVFTFGGYTPRGNSIFGLAPMLSDTDKKPFTAILYGNGPG
                YKVVGGERENVSMVDYAHNNYQAQSAVPLRHETHGGEDVAVFSKGPMAHLLHGVHEQNYVPHVMAYAACI
                GANLGHCAPASSLKDKTHTCPPCPAPELLGGPSVFLFPPKPKDTLMISRTPEVTCVVVDVSHEDPEVKFN
                WYVDGVEVHNAKTKPREEQYNSTYRVVSVLTVLHQDWLNGKEYKCKVSNKALPAPIEKTISKAKGQPREP
                QVYTLPPSREEMTKNQVSLTCLVKGFYPSDIAVEWESNGQPENNYKTTPPVLDSDGSFFLYSKLTVDKSR
                WQQGNVFSCSVMHEALHNHYTQKSLSLSPGKDIDDDDDDDDD (SEQ ID NO: 1201)

sTNALP-FcD10    LVPEKEKDPKYWRDQAQETLKYALELQKLNTNVAKNVIMFLGDGMGVSTVTAARILKGQLHHNPGEETRL
(w/o sig. seq.) EMDKFPFVALSKTYNTNAQVPDSAGTATAYLCGVKANEGTVGVSAATERSRCNTTQGNEVTSILRWAKDA
                GKSVGIVITTRVNHATPSAAYAHSADRDWYSDNEMPPEALSQGCKDIAYQLMHNIRDIDVIMGGGRKYMY
                PKNKTDVEYESDEKARGTRLDGLDLVDTWKSFKPRYKHSHFIWNRTELLTLDPHNVDYLLGLFEPGDMQY
                ELNRNNVTDPSLSEMVVVAIQILRKNPKGFFLLVEGGRIDHGHHEGKAKQALHEAVEMDRAIGQAGSLTS
                SEDTLIVVTADHSHVFTFGGYTPRGNSIFGLAPMLSDTDKKPFTAILYGNGPGYKVVGGERENVSMVDYA
                HNNYQAQSAVPLRHETHGGEDVAVFSKGPMAHLLHGVHEQNYVPHVMAYAACIGANLGHCAPASSLKDKT
                HTCPPCPAPELLGGPSVFLFPPKPKDTLMISRTPEVTCVVVDVSHEDPEVKFNWYVDGVEVHNAKTKPRE
                EQYNSTYRVVSVLTVLHQDWLNGKEYKCKVSNKALPAPIEKTISKAKGQPREPQVYTLPPSREEMTKNQV
                SLTCLVKGFYPSDIAVEWESNGQPENNYKTTPPVLDSDGSFFLYSKLTVDKSRWQQGNVFSCSVMHEALH
                NHYTQKSLSLSPGKDIDDDDDDDDD (SEQ ID NO: 1204)
```

FIG. 5C hsTNALP-Fc Protein Sequence
(With and Without Signal Sequence)

sTNALP-Fc
(w/sig. seq.)

MVSPFLVLAIGTCLTNSLVPEKEKDPKYWRDQAQETLKYALELQKLNTNVAKNVIMFLGDGMGVSTVTAA
RILKGQLHHNPGEETRLEMDKFPFVALSKTYNTNAQVPDSAGTATAYLCGVKANEGTVGVSAATERSRCN
TTQGNEVTSILRWAKDAGKSVGIVTTTRVNHATPSAAYAHSADRDWYSDNEMPPEALSQGCKDIAYQLMH
NIRDIDVIMGGGRKYMYPKNKTDVEYESDEKARGTRLDGLDLVDTMKSFKPRYKHSHFIWNRTELLTLDP
HNVDYLLGLFEPGDMQYELNRNNVTDPSLSEMVVAIQILRKNPKGFFLLVEGGRIDHGHHEGKAKQALH
EAVEMDRAIGQAGSLTSSEDTLTVVTADHSHVFTFGGYTPRGNSIFGLAPMLSDTDKKPFTAILYGNGPG
YKVVGGERENVSMVDYAHNNYQAQSAVPLRHETHGGEDVAVFSKGPMAHLLHGVHEQNYVPHVMAYAACI
GANLGHCAPASSLKDKTHTCPPCPAPELLGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 1220)

sTNALP-Fc
(w/o sig. seq.)

LVPEKEKDPKYWRDQAQETLKYALELQKLNTNVAKNVIMFLGDGMGVSTVTAARILKGQLHHNPGEETRL
EMDKFPFVALSKTYNTNAQVPDSAGTATAYLCGVKANEGTVGVSAATERSRCNTTQGNEVTSILRWAKDA
GKSVGIVTTTRVNHATPSAAYAHSADRDWYSDNEMPPEALSQGCKDIAYQLMHNIRDIDVIMGGGRKYMY
PKNKTDVEYESDEKARGTRLDGLDLVDTMKSFKPRYKHSHFIWNRTELLTLDPHNVDYLLGLFEPGDMQY
ELNRNNVTDPSLSEMVVAIQILRKNPKGFFLLVEGGRIDHGHHEGKAKQALHEAVEMDRAIGQAGSLTS
SEDTLTVVTADHSHVFTFGGYTPRGNSIFGLAPMLSDTDKKPFTAILYGNGPGYKVVGGERENVSMVDYA
HNNYQAQSAVPLRHETHGGEDVAVFSKGPMAHLLHGVHEQNYVPHVMAYAACIGANLGHCAPASSLKDKI
HTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQV
SLTCLVKGFYPSDIAVEWESNGQPENNYKTTPPVLDSDGSFFLYSKLTVDKSRWQQGNVFSCSVMHEALH
NHYTQKSLSLSPGK (SEQ ID NO: 1221)

FIG. 5D hsTNALP-FcD₁₀ DNA Sequence

```
atggttcac cattctagt actgccatt ggcacctgcc ttactaactc cttagtgcca gagaaagaga aagacccaa gtactggcga
gaccagcgc aagagacact gaaatatgcc ctggagcttc agaagctcaa caccaacgtg gctaagaatg tcatcatgtt cctgggagat
gggatgggtg tctccacagt gacggctgcc cgcatcctca agggtcagct ccaccacaac cctgggggag agaccaggct ggagatggac
aagttccct tgtggcctc ctccaagaca tcccaagca gccgggcacc gccggcacct acaacacca atgccaagt ccctgacagc ggcaccaagg
gtgaaggca atgaggcac cgtgggggta agcgcaggta agcggcaggt gaacgaggt cactccatc
ctgcgtggg ccaagacgc tgggaaatct gtgggcattg tgaccacgca gagagtgaac ggaacccagg ccaagcccgc ctacgcccac
tcggctgggg ggactggta ctcagacaac ctgagggctt gagcagggc tgtaaggaca tcgcctacca gctcatgcat
aacatcagg acattgacgt gatcatgggg gtggcccgga aatacatgta cccaagaat aaaactgatg tggagtatga gagtgacgag
aaagccaggg gcacgaggct ggacggcctg gaccctgttg acacctggaa gagcttcaaa ccagatataca agcactccca cttcatctgg
aaccgcacgg aactcctgac ccttgaccc cacaatgtgg actacctatt gggtctcttc gagcctgga acatgcaggg acatgcagta cgagctgaac
aggaacaacg tgacgaccc gtcactctcc gagatgtgtg tggtggccat ccagatcctg cggaagaacc ccaaaggctt cttcttgctg
gtggaaggag gcagaattga ccacgggcac catgaaggaa aagccaagca tggtcactgc gaggcggtgg agatgaccg ggccatcggg
caggcagca gcttgacctc ctcggaagac actctgaccg tggtcactgc acacagacaa cacgtcttca cattgtgga atacacccc
cgtggcaact ctatcttggg tctggcccc atgctgagtg acacagacaa gaagcccttc actgccatcc tgtatggcaa tgggcctgc
tacaaggtgg tgggcggtga acgagagaat gtctctcatg tggactatgc tcacaacaa tcacaacaag tccaccag agtctgctgt gccctgcgc
cacgagaccc acggcgggga ggacgtggcc gtcttctcca agggccccat ggcgcacgcg ctgcacgcg tccacgagca gaactacgtc
cccacgtga tggcgtatgc agcctgcatc gggccccaac tcggccactg tgctcctgcc agctcgCTTA AGgacaaaac tcacacatgc
ccaccgtgcc cagcacctga actcctgggg ggaccgtcag tcttcctctt cccccaaaa cccaaggaca cctcatgat ctcccggacc
cctgaggtca catggtggt ggtggacgtg agccacgaag acccctgaggt cagttcaac tggtacgtgg acggcgtgga ggtgcataat
gccaagacaa agccgcgga ggagcagtac aacagcacgt accgtgtggt cagcgtcctc accgtcctgc accaggactg gctgaatggc
aaggagtaca agtgcaaggt ctccaacaaa gccctccca gccccatcga gaaaaccatc tccaaagcca aagggcagcc ccgagaacca
caggtgtaca ccctgcccc atcccgggag gagatgacca agaaccaggt cagcctgacc tgcctggtca aaggcttcta tcccagcgac
atcgccgtgg agtgggagag caatgggcag ccggagaaca actacaagac cacgcctccc gtgctggact ccgacggctc cttcttcctc
tatagcaagc tcaccgtgga caagagcagg tggcagcagg ggaacgtctt ctcatgctcc gtgatgcatg aggctctgca caaccactac
acgcagaaga gcctctccct gtctccgggt aaaGATATCG ATGACGATGA CGATGACGAT GACGATGACT AG (SEQ ID NO: 1217)
```

FIG. 6

Human Soluble Tissue Nonspecific Alkaline Phosphatase (hsTNALP) Protein Sequence hsTNALP (1-502)

MVSPFLVLAIGTCLTNSLVPEKEKDPKYWRDQAQETLKYALELQKLNTNVAKNVIMFLGDGMGVSTVTAARI
LKGQLHHNPGEETRLEMDKFPFVALSKTYNTNAQVPDSAGTATAYLCGVKANEGTVGVSAATERSRCNTTQG
NEVTSILRWAKDAGKSVGIVTTTRVNHATPSAAYAHSADRDWYSDNEMPPEALSQGCKDIAYQLMHNIRDID
VIMGGGRKYMYPKNKTDVEYESDEKARGTRLDGLDLVDTWKSFKPRYKHSHFIWNRTELLTLDPHNVDYLLG
LFEPGDMQYELNRNNVTDPSLSEMVVAIQILRKNPKGFFLLVEGGRIDHGHHEGKAKQALHEAVEMDRAIG
QAGSLTSSEDTLTVVTADHSHVFTFGGYTPRGNSIFGLAPMLSDTDKKPFTAILYGNGPGYKVVGGERENVS
MVDYAHNNYQAQSAVPLRHETHGGEDVAVFSKGPMAHLLHGVHEQNYVPHVMAYAACIGANLGHCAPASS (SEQ ID NO: 1202)

hsTNALP (18-502)

LVPEKEKDPKYWRDQAQETLKYALELQKLNTNVAKNVIMFLGDGMGVSTVTAARILKGQLHHNPGEETRLEM
DKFPFVALSKTYNTNAQVPDSAGTATAYLCGVKANEGTVGVSAATERSRCNTTQGNEVTSILRWAKDAGKSV
GIVTTTRVNHATPSAAYAHSADRDWYSDNEMPPEALSQGCKDIAYQLMHNIRDIDVIMGGGRKYMYPKNKTD
VEYESDEKARGTRLDGLDLVDTWKSFKPRYKHSHFIWNRTELLTLDPHNVDYLLGLFEPGDMQYELNRNNVT
DPSLSEMVVAIQILRKNPKGFFLLVEGGRIDHGHHEGKAKQALHEAVEMDRAIGQAGSLTSSEDTLTVVTA
DHSHVFTFGGYTPRGNSIFGLAPMLSDTDKKPFTAILYGNGPGYKVVGGERENVSMVDYAHNNYQAQSAVPL
RHETHGGEDVAVFSKGPMAHLLHGVHEQNYVPHVMAYAACIGANLGHCAPASS    (SEQ ID NO: 1205)

FIG. 7
Exemplary Fc Sequence (IgG-1)

DKTHTCPPCPAPELLGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK (SEQ ID NO: 401)

FIG. 8

Multiple Sequence Alignment of Tissue Nonspecific Alkaline Phosphatase (TNALP)

```
CLUSTAL W (1.82) multiple sequence alignment: Tissue Nonspecific Alkaline Phosphatase 1
P09487|PPBT_BOVIN        MISPFLLIAI GTCFASSLVP EKEKDPKYWR DQAQQTLKNA LRLQTLNTNV AKNVIMFLGD
Q29486|PPBT_FELCA        MISPFLVLAI GTCLTNSLVP EKEKDPKYWR DQAQQTLKNA LELQKLNTNV VKNVIMFLGD
P05186|PPBT_HUMAN        MISPFLVLAI GTCLTNSLVP EKEKDPKYWR DQAQETLKYA LELQKLNTNV AKNVIMFLGD
P09242|PPBT_MOUSE        MISPFLVLAI GTCLINSFVP EKERDPSYWR QQAQETLKNA LKLQKLNTNV AKNIIMFLGD
P08289|PPBT_RAT          MILPFLVLAI CTCLINSFVP EKEKDPSYWR QQAQETLKNA LELQKLNTNV AKNIIMFLGD
Q9N0V0|Q9N0V0_CANFA      ---------- ---------- --EKDPKYWR DQAQQTLKYA LRLQNLNTNV AKNVIMFLGD Consensus                XXXXXXXXXX XXXXXXXXXX XXEXDPXYWR XQAQXTLKXA LXLQXLNTNV XKNXIMFLGD 61
P09487|PPBT_BOVIN        GMGVSTVTAA RILKGQLHHS PGEETKLEMD KFPYVALSKT YNTNAQVPDS AGTATAYLCG
Q29486|PPBT_FELCA        GMGVSTVTAA RILKGQLHHN PGEETRLEMD KFPYVALSKT YNTNAQVPDS AGTATAYLCG
P05186|PPBT_HUMAN        GMGVSTVTAA RILKGQLHHN PGEETRLEMD KFPFVALSKT YNTNAQVPDS AGTATAYLCG
P09242|PPBT_MOUSE        GMGVSTVTAA RILKGQLHHN TGEETRLEMD KFPFVALSKT YNTNAQVPDS AGTATAYLCG
P08289|PPBT_RAT          GMGVSTVTAA RILKGQLHHN TGEETRLEMD KFPYVALSKT YNTNAQVPDS AGTATAYLCG
Q9N0V0|Q9N0V0_CANFA      GMGVSTVTAT RILKGQLHHN PGEETRLEMD KFPYVALSKT YNTNAQVPDS AGTATAYLCG Consensus                GMGVSTVTAX RILKGQLHHX XGEETKLEMD KFPXVALSKT YNTNAQVPDS AGTATAYLCG 121
P09487|PPBT_BOVIN        VKANEGTVGV SAATQRSQCN TTQGNEVTSI LRWAKDAGKS VGIVTTTRVN HATPSASYAH
Q29486|PPBT_FELCA        VKANEGTVGV SAATQRTQCN TTQGNEVTSI LRWAKDSGKS VGIVTTTRVN HATPSAAYAH
P05186|PPBT_HUMAN        VKANEGTVGV SAATERSRCN TTQGNEVTSI LRWAKDAGKS VGIVTTTRVN HATPSAAYAH
P09242|PPBT_MOUSE        VKANEGTVGV SAATERTRCN TTQGNEVTSI LRWAKDAGKS VGIVTTTRVN HATPSAAYAH
P08289|PPBT_RAT          VKANEGTVGV SAATERTRCN TTQGNEVTSI LRWAKDAGKS VGIVTTTRVN HATPSAAYAH
Q9N0V0|Q9N0V0_CANFA      VRANEGTVGV SAATQRTHCN TTQGNEVTSI LRWAKDAGKS VGIVTTTRVN HATPSAAYAH Consensus                VKANEGTVGV SAATKRXXCN TTQGNEVTSI LRWAKDXGKS VGIVTTTRVN HATPSAXYAH
```

FIG. 8 (cont'd)

```
                    181
P09487|PPBT_BOVIN   SADRDWYSDN EMPPEALSQG CKDIAYQLMY NIKDIEVIMG GGRKYMFPKN RTDVEYELDE
Q29486|PPBT_FELCA   SADRDWYSDN EMPPEALSQG CKDIAYQLMH NVRDIEVIMG GGRKYMFPKN RTDVEYEMDE
P05186|PPBT_HUMAN   SADRDWYSDN EMPPEALSQG CKDIAYQLMH NIRDIDVIMG GGRKYMYPKN KTDVEYESDE
P09242|PPBT_MOUSE   SADRDWYSDN EMPPEALSQG CKDIAYQLMH NIKDIDVIMG GGRKYMYPKN RTDVEYELDE
P08289|PPBT_RAT     SADRDWYSDN EMPPEALSQG CKDIAYQLMH NIKDIDVIMG GGRKYMYPKN RTDVEYELDE
Q9NOVO|Q9NOVO_CANFA SADRDWYSDN EMPPEALSQG CKDIAYQLMH NVKDIEVIMG GGRKYMFPKN RTDVEYEMDE
Consensus           ********** ********** ********** *:.*:.***** *********** :*********
                    SADRDWYSDN EMPPEALSQG CKDIAYQLMX NXXDIXVIMG GGRKYMXPKN XTDVEYEXDE 241
P09487|PPBT_BOVIN   KARGTRLDGL NLIDIWKSFK PKHKHSHYVW NRTELLLALDP HSVDYLLGLF EPGDMQYELN
Q29486|PPBT_FELCA   KARGTRLDGL NLVDIWKSFK PRHKHSHYVW NRTELLTLDP YGVDYLLGLF EPGDMQYELN
P05186|PPBT_HUMAN   KARGTRLDGL DLVDTWKSFK PRYEHSHFIW NRTELLIEDP HNVDYLLGLF EPGDMQYELN
P09242|PPBT_MOUSE   KARGTRLDGL DLISIWKSFK PRHKHSHYVW NRTELLALDP SRVDYLLGLF EPGDMQYELN
P08289|PPBT_RAT     KARGTRLDGL DLISIWKSFK PRHKHSHYVW NRTELLALDP SRVDYLLGLF EPGDMQYELN
Q9NOVO|Q9NOVO_CANFA KSTGARLDGL NLIDIWKNFK PRHKHSHYVW NRTELLALDP YTVDYLLGLF DEGDMQYELN
Consensus           *: *:****** ::*:.********** :::****** ********** ****
                    KXXGXRLDGL XLXXXWKXFK PXXKHSHXKW NRTXLLKLDP XXVDYLLGLF XPGDMQYELN 301
P09487|PPBT_BOVIN   RNNATDPSLS EMVEMATRIL NKNPKGFFLL VEGGRIDHGH EAVEMDQAIG
Q29486|PPBT_FELCA   RNSTTDPSLS EMVETAIKIL SKNPKGFFLL VEGGRIDHGH EAVEMDQAIG
P05186|PPBT_HUMAN   RNNVTDPSLS EMVVVAIQIL RKNPKGFFLL VEGGRIDHGH EAVRMDRAIG
P09242|PPBT_MOUSE   RNNLTDPSLS EMVEVALRIL TKNLKGFFLL VEGGRIDHGH EAVEMDQAIG
P08289|PPBT_RAT     RNNLTDPSLS EMVEVALRIL TKNPKGFFLL VEGGRIDHGH EAVEMDEAIG
Q9NOVO|Q9NOVO_CANFA RNNVTDPSLS EMVEIAIKIL SKMPRGFFLL VEGGRIDHGH EAVEMDRAIG
Consensus           **. ****** ***  :::** ********** *********** *********
                    RNXXTDPSLS EMVXXAXXIL XKXXXGFFLL VEGGRIDHGH EAVEMDXAIG
```

FIG. 8 (cont'd)

```
        361
P09487|PPBT_BOVIN    QAGAMTSVED TLTVVTADHS HVFTFGGYTP RGNSIFGLAP MVSDTDKKPF TAILYGNGPG
Q29486|PPBT_FELCA    RAGAMTSVED TLTIVTADHS HVFTFGGYTP RGNSIFGLAP MVSDTDKKPF TSILYGNGPG
P05186|PPBT_HUMAN    QAGSLTSSED TLTVVTADHS HVFTFGGYTP RGNSIFGLAP MLSDTDKKPF TAILYGNGPG
P09242|PPBT_MOUSE    KAGAMTSQKD TLTVVTADHS HVFTFGGYTP RGNSIFGLAP MVSDTDKKPF TAILYGNGPG
P08289|PPBT_RAT      KAGTMTSQKD TLTVVTADHS HVFTFGGYTP RGNSIFGLAP MVSDTDKKPF TAILYGNGPG
Q9N0V0|Q9N0V0_CANFA  KAGVMTSLED TLTVVTADHS HVFTFGGYTP RGNSIFGLAP MVSDTDKKPF TAILYGNGPG
Consensus            :**.:*** ::***:*** ********** ********** *:********* *:*******

421
P09487|PPBT_BOVIN    YKVVGGEREN VSMVDYAHNN YQAQSAVPLR HETHGGEDVA VFAKGPMAHL LHGVQEQNYI
Q29486|PPBT_FELCA    YKVVGGEREN VSMVDYAHNN YQAQSAVPLR HETHGGEDVA VFAKGPMAHL LHGVHEQNYI
P05186|PPBT_HUMAN    YKVVGGEREN VSMVDYAHNN YQAQSAVPLR HETHGGEDVA VFSKGPMAHL LHGVHEQNYV
P09242|PPBT_MOUSE    YKVVDGEREN VSMVDYAHNN YQAQSAVPLR HETHGGEDVA VFAKGPMAHL LHGVHEQNYI
P08289|PPBT_RAT      YKVVDGEREN VSMVDYAHNN YQAQSAVPLR HETHGGEDVA VFAKGPMAHL LHGVHEQNYI
Q9N0V0|Q9N0V0_CANFA  YKVVGGEREN VSMVDYAHNN YQAQSAVPLR HETHGGEDVA VFAKGPMAHL LHGVXEQNYX
Consensus            ****.***** ********** ********** ********** **:******* ****:****:

481
P09487|PPBT_BOVIN    PHVMAYAACI GANRDHCASA SSSGSPSPGP LLLLALLPL LLLLALLPL GSLF(SEQ ID NO: 1206)
Q29486|PPBT_FELCA    PHVMAYAACI GANLDHCASA SSAGGPSPGP LFLLLALPSL GILF(SEQ ID NO: 1207)
P05186|PPBT_HUMAN    PHVMAYAACI GANLGHCAFA SSAGSLIAAGP LLLALALYPL SVLF(SEQ ID NO: 1208)
P09242|PPBT_MOUSE    PHVMAYASCI GANLDHCAWA GSGSAPSPGA LLLPLALFPL PTLF(SEQ ID NO: 1209)
P08289|PPBT_RAT      PHVMAYASCI GANLDHCAWA SSASSPSPGA LLLLLALFPL RTLF(SEQ ID NO: 1210)
Q9N0V0|Q9N0V0_CANFA  PHVMAYAACI GANQDHCASA SSAGGPSPGP LLLLLALLPV GILF(SEQ ID NO: 1211)
Consensus            *******:** ***..****. .*..:.:*.. . .:**.**: .**

PHVMAYAXCI GANXXHCAXA XSXXXXXXGX LXLXLAKKKKK XXLF(SEQ ID NO: 1216)
```

FIG. 9
Multiple Sequence Alignment of Alkaline Phosphatase
(TNALP, GALP, PLALP, and IALP)

```
CLUSTAL 2.0.5 multiple sequence alignment

TNALPrn         MILP------F LVLAIGTCLT NSFVPEKEKD PSYWRQQAQE TLKNALKLQK LNTNVAKNII    55
TNALPmm         MISP------F LVLAIGTCLT NSFVPEKERD PSYWRQQAQE TLKNALKLQK LNTNVAKNVI    55
TNALPhs         MISP------F LVLAIGTCLT NSLVPEKEKD PKYWRDQAQE TLKYALELQK LNTNVAKNVI    55
TNALPcf         ---------- ---------- -------EKD PKYWRDQAQQ TLKYALRLQN LNTNVAKNVI    33
TNALPfc         MISP------F LVLAIGTCLT NSLVPEKEKD PKYWRDQAQQ TLKNALRLQK LNTNVVKNVI    55
TNALPbt         MISP------F LLLAIGTCFA SSLVPEKEKD PKYWRDQAQC TLKNALRLQT LNTNVAKNVI    55
GALPhs          MQGPWV----L LLLGLRLQLS LGIIPVEEEN PDFWNRQAAE ALGAAKKLQP AQT-AAKNLI    56
PLALPhs         MLGPCMLLLL LLLGLRLQLS LGIIPVEEEN PDFWNREAAE ALGAAKKLQP AQT-AAKNLI    59
IALPhs          MQGPWV----L LLLGLRLQLS LGVIPAEEEN PAFWNRQAAE ALDAAKKLQP IQK-VAKNLI    56
                   *          *  *   *                *  *   *    *         **  **:*
Consensus       XXXXXXXXXX XXXXXXXXXX XXXXXXXEXX PXXWXXXAXX XLXXAXXLQX XXXXXXKNXI TNALPrn         MFLGDGMGVS TVTAARILKG QLHHNTGEET RLEMDKFPFV ALSKTYNTNA QVPDSAGTAT    115
TNALPmm         MFLGDGMGVS TVTAARILKG QLHHNTGEET RLEMDKFPFV ALSKTYNTNA QVPDSAGTAT    115
TNALPhs         MFLGDGMGVS TVTAARILKG QLHHNPGEET RLEMDKFPFV ALSKTYNTNA QVPDSAGTAT    115
TNALPcf         MFLGDGMGVS TVTATRILKG QLHHNPGEET RLEMDKFPYV ALSKTYNTNA QVPDSAGTAT    93
TNALPfc         MFLGDGMGVS TVTAARILKG QLHHNPGEET RLEMDKFPYV ALSKTYNTNA QVPDSAGTAT    115
TNALPbt         MFLGDGMGVS TVTAARILKG QLHHSPGEET KLEMDKFPYV ALSKTYNTNA QVPDSAGTAT    115
GALPhs          IFLGDGMGVS TVTAARILKG QKKDKLGPET FLAMDRFPYV ALSKTYSVDK HVPDSGATAT    116
PLALPhs         IFLGDGMGVS TVTAARILKG QKKDKLGPEI PLAMDRFPYV ALSKTYNVDK HVPDSGATAT    119
IALPhs          LFLGDGLGVP TVTATRILKG QKNGKLGPET PLAMDRFPYL ALSKTYNVDR QVPDSAATAT    116
                 ****  **  **** ***** *       *      *     *      *        * ***
Consensus       XFLGDGXGVX TVTAXRILKG QXXXXXXGXEX XLXMDXFPXX ALSKTYXXXX XVPDSXXTAT
```

FIG. 9 (cont'd)

```
TNALPrn      AYLCGVKANE GTVGVSAATE RTRCNTTQGN EVTSILRWAK DAGKSVGIVT TTRVNHATPS 175
TNALPmm      AYLCGVKANE GTVGVSAATE RTRCNTTQGN EVTSILRWAK DAGKSVGIVT TTRVNHATPS 175
TNALPhs      AYLCGVKANE GTVGVSAATE RSRCNTTQGN EVTSILRWAK DAGKSVGIVT TTRVNHATPS 175
TNALPcf      AYLCGVKANE GTVGVSAATQ RTHCNTTQGN EVTSILRWAK DAGKSVGIVT TTRVNHATPS 153
TNALPfc      AYLCGVKANE GTVGVSAATQ RTQCNTTQGN EVTSILRWAK DSGKSVGIVT TTRVNHATPS 175
TNALPbt      AYLCGVKANE GTVGVSAATQ RSQCNTTQGN EVTSILRWAK DAGKSVGIVT TTRVNHATPS 175
GALPhs       AYLCGVKGNF QTIGLSAAAR FNQCNTTRGN EVISVMNRAK KAGKSVGVVT TTRVQHASPA 176
PLALPhs      AYLCGVKGNF QTIGLSAAAR FNQCNTTRGN EVISVMNRAK KAGKSVGVVT TTRVQHASPA 179
IALPhs       AYLCGVKANF QTIGLSAAAR FNQCNTTRGN EVISVMNRAK QAGKSVGVVT TTRVQHASPA 176
Consensus    ******:.*  *:*:****:  .:****:*** **.*::.**  :.******:** *****:*:.

TNALPrn      AAYAHSADRD WYSDNEMPPE ALSQGCKDIA YQLMHNIKDI DVIMGGGRKY MYPKNRTDVE 235
TNALPmm      AAYAHSADRD WYSDNEMPPE ALSQGCKDIA YQLMHNIKDI DVIMGGGRKY MYPKNRTDVE 235
TNALPhs      AAYAHSADRD WYSDNEMPPE ALSQGCKDIA YQLMHNIRDI DVIMGGGRKY MYPKNKTDVE 235
TNALPcf      AAYAHSADRD WYSDNEMPPE ALSQGCKDIA YQLMHNVKDI EVIMGGGRKY MFPKNRTDVE 213
TNALPfc      AAYAHSADRD WYSDNEMPPE ALSQGCKDIA YQLMYNIKDI EVIMGGGRKY MFPKNRTDVE 235
TNALPbt      ASYAHSADRD WYSDNEMPPE ALSQGCKDIA YQLMYNIKDI EVIMGGGRKY MFPKNRTDVE 235
GALPhs       GAYAHTVNRN WYSDADVPAS ARQEGCQDIA TQLISNM--DI DVILGGGRKY MFPMGTPDPE 235
PLALPhs      GTYAHTVNRN WYSDADVPAS ARQEGCQDIA TQLISNM--DI DVILGGGRKY MFRMGTPDPE 238
IALPhs       GTYAHTVNRN WYSDADMPAS ARQEGCQDIA TQLISNM--DI DVILGGGRKY MFPMGTPDPE 235
Consensus    .:***.::*: ****.:.*   *.:.:*:**: **:..:  .*  :*:.******** :* .  *.*
XXYAHXXXXRX WYSDXXXPXX AXXXGCXDIA XQLXXNXXDI XVIXGGGRKY MXXXXXXDXE TNALPrn      YELDEKARGT RLDGLDLISI WKSFKPRHKH SHYVWNRTEL LALDPS--RVD YLLGLFEPGD 294
TNALPmm      YELDEKARGT RLDGLDLISI WKSFKPRHKH SHYVWNRTEL LALDPS--RVD YLLGLFEPGD 294
TNALPhs      YESDEKARGT RLDGLDLVDT WKSFKPRYKH SHFIWNRTEL LTLDPH--NVD YLLGLFEPGD 294
TNALPcf      YEMDEKSTGA RLDGLNLIDI WKRNFKPRHKH SHYVWNRTEL LALDPY--TVD YLLGLFDPGD 272
TNALPfc      YEMDEKARGT RLDGLNLVDI WKSFKPRHKH SHYVWNRTEL LTLDPY--GVD YLLGLFEPGD 294
TNALPbt      YELDEKARGT RLDGLNLIDI WKSFKPRHKH SHYVWNRTDL LALDPH--SVD YLLGLFEPGD 294
GALPhs       YPDDYSQGGT RLDGKNLVQE WL----AKHQG ARYVWNRTEL LQASLDPSVT HLMGLFEPGD 292
PLALPhs      YPDDYSQGGT RLDGKNLVQE WL----AKRQG ARYVWNRTEL MQASLDPSVT HLMGLFEPGD 295
IALPhs       YPADASQNGI RLDGKNLVQE WL----AKHQG AWYVWNRTEL MQASLDQSVT HLMGLFEPGD 292
Consensus    *  .  :  .  ****: :::   *     .::   : ******.:  .:  . .  :*:***.***
YXXDXXXXGX RLDGXXLXXX WXXXXXXXXX XXXXWNRTXL XXXXXXXXXX XLXGLFXPGD
```

FIG. 9 (cont'd)

```
TNAlPrn    MQYELNRNNL TDPSLSEMVE VALKILTKNP KGFFLLVEGG RIDHGHHEGK AKQALHEAVE 354
TNAlPmm    MQYELNRNNL TDPSLSEMVE VALRILTKNL KGFFLLVEGG RIDHGHHEGK AKQALHEAVE 354
TNAlPhs    MQYELNRNNV TDPSLSEMVV VAIQILRKNP KGFFLLVEGG RIDHGHHEGK AKQALHEAVE 354
TNAlPcf    MQYELNRNNV TDPSLSEMVE IAIKILSKKP KGFFLLVEGG RIDHGHHEGK AKQALHEAVE 332
TNAlPfc    MQYELNRNST TDPSLSEMVE IAIKILSKNP KGFFLLVEGG RIDHGHHEGK AKQALHEAVE 354
TNAlPbt    MQYELNRNNA TDPSLSEMVE MAIRILNKNP KGFFLVEGG RIDHGHHEGK AKQALHEAVE 354
GAlPhs     MRYEIHRDST LDPSLMEMTE AALLLLSRNP RGFFLFVEGG RIDHGHHESR AYRALTETIM 352
PlAlPhs    MRYEIHRDST LDPSLMEMTE AALRLLSRNP RGFFLFVEGG RIDHGHHESR AYRALTETIM 355
IAlPhs     TRYEIHRDPT LDPSLMEMTE AALRLLSRNP RGFYLFVEGG RIDHGHHEGV AYQALTEAVM 352
           :**::*:    ****  **.  *:  :* :: :*:*:*:**** ********.  * :: :* :
Consensus  XXYEXXRXXX XDPSLXEMXX XAXXXLXXXX XGFXLXVEGG RIDHGHHEXX AXXALXEXXX TNAlPrn    MDEAIGKAGT MTSQKDTLIV VTADHSHVFT FGGYTPRGNS IFGLAPMVSD TDKKPFTAIL 414
TNAlPmm    MDQAIGKAGA MTSQKDTLTV VTADHSHVFT FGGYTPRGNS IFGLAPMVSD TDKKPFTAIL 414
TNAlPhs    MDRAIGQAGS LTSSEDTLTV VTADHSHVFT FGGYTPRGNS IFGLAPMLSD TDKKPFTAIL 414
TNAlPcf    MDRAIGKAGV MTSLEDILTV VTADHSHVFT FGGYTPRGNS IFGLAPMVSD TDKKPFTSIL 392
TNAlPfc    MDRAIGRAGA MTSVEDTLTI VTADHSHVFT FGGYTPRGNS IFGLAPMVSD TDKKPFTSIL 414
TNAlPbt    MDQAIGQAGA MTSVEDTLTV VTADHSHVFT FGGYTPRGNS IFGLAPMVSD TDKKPFTAIL 414
GAlPhs     FDDAIERAGQ LTSEEDTLSL VTADHSHVFS FGGYPLRGSS IFGLAPGKAR -DRKAYTVLL 411
PlAlPhs    FDDAIERAGQ LTSEEDTLSL VTADHSHVFS FGGYPLRGSS IFGLAPGKAR -DRKAYTVLL 414
IAlPhs     FDDAIERAGQ LTSEEDTLTL VTADHSHVFS FGGYTLRGSS IFGLAPSKAQ -DSKAYTSIL 411
           :* *** **: :.: *: *: ******** * .* :. *  * .
Consensus  XDXAIXXAGX XTSXXDTLXX VTADHSHVFX FGGYXXRGXS IFGLAPXXXX XDXKXXTXXL TNAlPrn    YGNGPGYKVV DGERENVSMV DYAHNNYQAQ SAVPLRHETH GGEDVAVFAK GPMAHLLHGV 474
TNAlPmm    YGNGPGYKVV DGERENVSMV DYAHNNYQAQ SAVPLRHETH GGEDVAVFAK GPMAHLLHGV 474
TNAlPhs    YGNGPGYKVV GGERENVSMV DYAHNNYQAQ SAVPLRHETH GGEDVAVFSK GPMAHLLHGV 474
TNAlPcf    YGNGPGYKVV GGERENVSMV DYAHNNYQAQ SAVPLRHETH GGEDVAVFAK GPMAHLLHGV 452
TNAlPfc    YGNGPGYKVV GGERENVSMV DYAHNNYQAQ SAVPLRHETH GGEDVAVFAK GPMAHLLHGV 474
TNAlPbt    YGNGPGYKVV GGERENVSMV DYAHNNYQAQ SAVPLRHETH GGEDVAVFAK GPMAHLLHGV 474
GAlPhs     YGNGPGYVLK DGARPDVTES ESGSPEYRQQ SAVPLDGETH AGEDVAVFAR GPQAHLVHGV 471
PlAlPhs    YGNGPGYVLK DGARFDVTES ESGSPEYRQQ SAVPLDEETH AGEDVAVFAR GPQAHLVHGV 474
IAlPhs     YGNGPGYVFN SGVRPDVNES ESGSPDYQQQ AAVPLSSETH GGEDVAVFAR GPQAHLVHGV 471
           ******* .  .*: *  *. ::     * :* :**:.  **.   *. ******:: ***:***
Consensus  YGNGPGYXXX XGXRXXVXXX XXXXXXYXXQ XAVPLXXETH XGEDVAVFXX GPXAHLXHGV
```

FIG. 9 (cont'd)

```
TNALPrn     HEQNYIPHVM AYASCIG---- -ANLDHCAWA SSASSPSPGA LLLPLALFPL RTLF------ 524
TNALPmm     HEQNYIPHVM AYASCIG---- -ANLDHCAWA GSGSAPSPGA LLLPLAVLSL PTLF------ 524
TNALPhs     HEQNYIPHVM AYAACIG---- -ANLGHCAPA SSAGSLAAGP LLLALALYPL SVLF------ 524
TNALPcf     HEQNYIPHVM AYAACIG---- -ANQDHCASA SSAGGPSPGP LLLLLALLPV GILF------ 502
TNALPfc     HEQNYIPHVM AYAACIG---- -ANLDHCASA SSAGGPSPGP LFLLLALPSL GILF------ 524
TNALPbt     QEQNYIPHVM AYAACIG---- -ANRDHCASA SSSGSPSPGP LLLLLALLPL GSLF------ 524
GALPhs      QEQTFIAHVM AFAACLEPYT ACDLAPRAGT TDAAHPGPSV VPALLPLLAG TLLLLGTATA 531
PLALPhs     QEQTFIAHVM AFAACLEPYT ACDLAPPAGT TDAAHPGRSV VPALLPLLAG TLLLLETATA 534
IALPhs      QEQSFVAHVM AFAACLEPYT ACDLAPPACT TDAAHP---- VAASLPLLAG TLLLLGASAA 527
            :*** . .: *::*.:*.   .  :        .             ..   *:          
Consensus   XEQXXXXHVM AXAXCXXXXX XXXXXXXXAXX XXXXXXXXXX XXXXLXXXXX XXLXXXXXXX TNALPrn     --    (SEQ ID NO: 1210)
TNALPmm     --    (SEQ ID NO: 1209)
TNALPhs     --    (SEQ ID NO: 1208)
TNALPcf     --    (SEQ ID NO: 1211)
TNALPfc     --    (SEQ ID NO: 1207)
TNALPbt     --    (SEQ ID NO: 1206)
GALPhs      P 532 (SEQ ID NO: 1213)
PLALPhs     P 535 (SEQ ID NO: 1214)
IALPhs      P 528 (SEQ ID NO: 1212)
Consensus   X     (SEQ ID NO: 1215)
```

FIG. 10

ALP-TNALP Consensus Sequences Excluding Pathogenic Mutations

```
XXXXXXXXXX XXXXXXXXXX XXXXXXXEXX PXXWXXXAXX XLXXAXXLQX XXXXXAKNXI    60
XFLGDGMGVX TVTAXRILKG QXXXXXGXEX XLXMDXFPXX ALSKTYXXXX XVPDSXXTAT   120
AYLCGVKXNX XTXGXSAAXX XXXCNTTXGN EVTSXXXXAK XXGKSVGXVT TTRVXHAXPX   180
XXYAHXXXRX WYSDXXXPXX AXXXGCXDIA XQLXXNXXDI XVIXGGGRKY MXXXXXXDXE   240
YXXDXXXXGX RLDGXXLXXX WXXXXXXXXX XXXXWNRTXL XXXXXXXXVX XLXGLFXPGD   300
MXYEXXRXXX XDPSLXEMXX XAXXXLXXXX XGFXLXVEGG RIDHGHHEXX AXXALXEXXX   360
XDXAIXXAGX XTSXXDTLXX VTADHSHVFX FGGYXXRGXS IFGLAPXXXX XDXKXXTXXL   420
YGNGPGYXXX XGXRXXVXXX XXXXXXYXXQ XAVPLXXETH XGEDVAVFXX GPXAHLXHGV   480
XEQXXXXHVM AXAXCXXXXX XXXXXXXAXX XXXXXXXXXX XXXXLXXXXX XXLXXXXXXX   540
X                                                                   541
(SEQ ID NO: 1218)
```

FIG. 11

TNALP Consensus Sequences Excluding Pathogenic Mutations

```
MIXPFLXLAI GTCXXXSXVP EKEXDPXYWR XQAQXTLKXA LXLQXLNTNV AKNXIMFLGD   60
GMGVSTVTAX RILKGQLHHX XGEETXLEMD KFPXVALSKT YNTNAQVPDS AGTATAYLCG  120
VKANEGTVGV SAATXRXXCN TTQGNEVTSI LRWAKDXGKS VGIVTTTRVN HATPSAXYAH  180
SADRDWYSDN EMPPEALSQG CKDIAYQLMX NXXDIXVIMG GGRKYMXPKN XTDVEYEXDE  240
KXXGXRLDGL XLXXXWKXFK PXXKHSHXXW NRTXLLXLDP XXVDYLLGLF XPGDMQYELN  300
RNXXTDPSLS EMVXXAXXIL XKXXXGFFLL VEGGRIDHGH HEGKAKQALH EAVEMDXAIG  360
XAGXXTSXXD TLTXVTADHS HVFTFGGYTP RGNSIFGLAP MXSDTDKKPF TXILYGNGPG  420
YKVVXGEREN VSMVDYAHNN YQAQSAVPLR HETHGGEDVA VFXKGPMAHL LHGVXEQNYX  480
PHVMAYAXCI GANXXHCAXA XSXXXXXXGX LXLXLAXXXX XXLF                   524
```

(SEQ ID NO: 1219)

FIG. 12

Multiple Sequence Alignment of Natriuretic Peptides

```
Human ANP         --------SLRRSSCFGGRMDRIGAQSGLGCNSFRY---------  (SEQ ID NO: 1)
Human urodilatin  TAPRSLRRSSCFGGRMDRIGAQSGLGCNSFRY---------        (SEQ ID NO: 2)
Human BNP         -SPKMVQGSGCFGRKMDRISSSSGLGCKVLRRH--------        (SEQ ID NO: 3)
Human CNP22       --------GLSKGCFGLKLDRIGSMSGLGC-----------        (SEQ ID NO: 4)
DNP               --------EVKYDPCFGHKIDRINHVSNLGCPSLRDPRPNAPSTSA  (SEQ ID NO: 5)
                          ***  :*** .  *.*.***

CONSENSUS SEQUENCE           CFGXXXDRIXXXSXLGC                      (SEQ ID NO: 6)
```

FIG. 13

Sequences of Human CNP53, CNP22, and CNP (ring only)

```
Human CNP53           DLRVDTKSRAAWARLLQEHPNARKYKGANKKGLSKGCFGLKLDRIGSMSGLGC   (SEQ ID NO: 11)
Human CNP22           --------------------------------GLSKGCFGLKLDRIGSMSGLGC   (SEQ ID NO: 4)
Human CNP (ring only) -------------------------------------CFGLKLDRIGSMSGLGC   (SEQ ID NO: 12)
```

FIG. 14

Multiple Sequence Alignment of C-Type Natriuretic Peptides from Various Species

```
Human                       ------GLSKGCFGLKLDRIGSMSGLGC  (SEQ ID NO: 4)
Bovine                      ------GLSKGCFGLKLDRIGSMSGLGC  (SEQ ID NO: 13)
Sheep                       ------GLSKGCFGLKLDRIGSMSGLGC  (SEQ ID NO: 14)
Mouse                       ------GLSKGCFGLKLDRIGSMSGLGC  (SEQ ID NO: 15)
Pig                         ------GLSKGCFGLKLDRIGSMSGLGC  (SEQ ID NO: 16)
Micrurus fulvius fulvius    GLAKEALGDGCFGLKLDRIGTSSGLGC   (SEQ ID NO: 17)
Taeniopygia guttata         ---------GCFGLKLDRIGTFSGLGC   (SEQ ID NO: 18)
Chicken                     ------GLSRSCFGVKLDRIGSMSGLGC  (SEQ ID NO: 19)
Rana catesbeiana            --------SRGCFGVKLDRIGAFSGLGC  (SEQ ID NO: 20)
Eel                         -------GWNRGCFGLKLDRIGSLSGLGC (SEQ ID NO: 21)
Trout                       -------GWNRGCFGLKLDRIGSMSGLGC (SEQ ID NO: 22)
Ornithorhynchus anatinus    ------GLSKGCFGLKLDRIGSTSGLGC  (SEQ ID NO: 23)
Trimeresurus flavoviridis   -------KGCEGHKLDRIGSTSGLGC    (SEQ ID NO: 24)
Polypterus endlicheri       -------SKGCFGLKLDRIGSISGLGC   (SEQ ID NO: 25)
Xenopus laevis              -------LSKGCFGLKLDRIGVVSGLGC  (SEQ ID NO: 26)
Oryzias latipes             ---------GCFGMKMDRIGSISGLGC   (SEQ ID NO: 27)
Tetraodon nigroviridis      ---------GCFGMKIDRIGSISGLGC   (SEQ ID NO: 28)
Pseudechis australis        ----SKIGDGCFGLPLDHIGSVSGLGC   (SEQ ID NO: 29)
                                     ***  :*:;** *****

CONSENSUS SEQUENCE          XXXXXXXXXXXCFGXXXDXIGXXSGLGC  (SEQ ID NO: 30)
```

FIG. 15A
Multiple Alignment of C-Type Natriuretic Peptides from Various Species

```
sp|Q8AYR5|ANFC2_ORYLA      ---MAVCSSSS---------LILLTVFLSVAVETRP-SSDRDE------- 30
sp|Q805D5|ANFC2_TAKRU      ......MAASSSSF............VPLVLLFLAIPVEPRP-SMTRDE.......... 30
sp|Q76KW6|ANFC_ACITR       ---MSISSSSSSSSSSSSCLLLISLMLLAASCQGRPDLQHRNH------- 40
sp|Q61839|ANFC_MOUSE       ----MHLSQLI-------ACALLLALLSLRPSEAKPGTP----------- 28
tr|Q544K5|Q544K5_MOUSE     -----MHLSQLI-------ACALLLALLSLRPSEAKPGTP---------- 28
tr|Q8VHG9|Q8VHG9_NOTAL     -----MHLSQLI-------ACALLLALLSLRPSEAKPGTP---------- 28
sp|P55207|ANFC_RAT         -----MHLSQLI-------ACALLLALLSLRPSEAKPGTP---------- 28
sp|P55206|ANFC_BOVIN       -----MHLSQLI-------ACALLLALLSLRPSEAKPGAP---------- 28
sp|P56283|ANFC_SHEEP       -----MHLSQLI-------ACALLLSLLSLRPSEAKPGAP---------- 28
sp|P18104|ANFC_PIG         -----MHLSQLL-------ACALLLTLLSLRPSEAKPGAP---------- 28
sp|P23582|ANFC_HUMAN       -----MHLSQLI-------ACALLLTLLSLRPSEAKPGAP---------- 28
sp|P84715|ANF39_ORNAN      -----MHLSHLL-------AWALLLTLLSLR-AEAKPPSPQ--------- 28
tr|Q9QZ96|Q9QZ96_CAVPO     ................................................
sp|Q800I7|ANFC4_ORYLA      ----MNLSYLV-------ACGELVFFLSDK-MDAQPLTPAQ--------- 29
sp|Q805D3|ANFC4_TAKRU      ....MNLSYLV........ACGLMITLLSVR-MGAKPLSQAQ........ 29
tr|C1BXI5|C1BXI5_ESOLU     -----MNISYLV------ACGLMITLLSVR-SGAKPLTAAQ--------- 29
tr|D2KXA5|D2KXA5_ANGJA     .......MNVSQLM..........VCGLLMALFSFS-TEAKSLIPAQ........ 29
tr|Q1XGY7|Q1XGY7_9ACTI     ....MNISHLV........ACGLLVALLTVT-MFAKPLTQSQ........ 29
sp|P40756|ANFD_RANCA       ----MHFCHIV-------GWGLVLAVLYLR-TEAKPVAQAH--------- 29
sp|P0C7P5|BNP_TRIFL        ....MFVSRLA........ASGLLLLALLALSLDGKPVEHQSKPGR...... 33
sp|P0C7P6|BNP_TRIGA        -----MFVSRLA-------ASGLLLLALLALSLDGKPVQE-KFGR------ 32
sp|Q6LEM5|BNP1_BOTJA       -----MVLSRLA-------ASGLLLLALLALSVDGKPVQQWAQS------ 32
sp|Q9PW56|BNP2_BOTJA       -----MVLSRLA-------ASGLLLLALLALSVDGKPVQQWAQGG----- 33
sp|P68515|BNP_BOTIN        -----MVLSRLA-------ASGLLLLALLALSVDGKPVQQWAQGG----- 33
sp|Q90Y12|BNP_CRODU        -----MFVSRLA-------ASGLLLLALLAVSLDGKPLQQWS-------- 30
sp|Q2PE51|BNP_CRODO        -----MFVSRLA-------ASGLLLLALLAVSLDGKPLQQWS-------- 30
sp|B0VXV8|BNP_SISCA        -----MFVSRLA-------ASGLLLLALLAVSLDGKPVQQWS-------- 30
sp|Q27J49|BNP_LACMU        -----MFVSRLA-------ASGLLLLALLAVSLDGKPVQQWSH------- 31
sp|P01021|BNP_AGKHA        -----MFVSRLA-------ASGLLLLALMALSLDGKPVQQWSQGRPFGPPI 39
sp|Q09GK2|VNP_PH1OL        -----MVASRLA-------AGGLLLLALLALALDGKPAPP-QP------- 30
tr|D1MZV3|D1MZV3_RHATT     -----MFASRLA-------ALGLLLLALV----LDGKPAPPPQP------ 28
tr|Q7TIM4|Q7TIM4_BOTJR     -----HEKPSRSG--------AKSAAVGAKLAASSDSAADECSSGRK--------- 34
tr|Q402A2|Q402A2_PETMA     ................................................
tr|Q402A3|Q402A3_LAMJA     --MKLQLLMMV-------VVVGSWTFLG----VCAKPLTSYELYD----- 32
tr|Q402A1|Q402A1_9PETR     --MRRQVLVMV---------VMVVVMVVMSGKSVTAKPVASYELLD------ 35
sp|P21805|ANFC_CHICK       ................................................
tr|A9CDT6|A9CDT6_CHICK     ---------MKLLFC--------PGFFLLLIVSQKQAMAKPIS------------ 26
sp|P20968|ANFC_RANCA       ......MSYKRGTC..........LGFFMLLMVSHHHTKGKPLS...... 28
sp|P55208|ANFC_TRISC       ---MSGQTSFY-------CGLLLVLLIQAQ---ARPRS----------- 25
sp|P23259|ANFC_SCYCA       ..........................RPRS.......... 4
sp|P41313|ANFC_SQUAC       ---MSGHTSFY-------CGLLLLLLIQVQ---ARPRA----------- 25
tr|Q2MH72|Q2MH72_9CHON     ---MSGNTNFY-------CGLVLLLLLQVQ---GRPRS----------- 25
tr|Q2MH73|Q2MH73_9CHON     ---MSGNTNFY-------CGLVLLLLLQVQ---GRPRS----------- 25
tr|Q2MH71|Q2MH71_9CHON     ---MSGNTNFY-------CGLVLLLLLQVQ---GRPRS----------- 25
tr|Q2MH74|Q2MH74_DASAK     ---MSGNTNFY-------CGLVLLLLLQVQ---GRPRS----------- 25
tr|Q2PF87|Q2PF87_CALMI     ---MNAHVSFP-------CGLMLLLLIQVQVQ-ARPRTG----------- 28
sp|Q800I8|ANFC3_ORYLA      ------MSLRAF-------MLCVCLLQSVG---ARPAS----------- 23
tr|Q4ADV1|Q4ADV1_ORYLA     ------MSLRAF-------MLCVCLLQSVG---ARPAS----------- 23
sp|Q805D4|ANFC3_TAKRU      ---MSLNLPGY-------ALFFILLVASSG---AKPAP----------- 25
tr|C0H7B0|C0H7B0_SALSA     -MKMISNIQFF-------CLTALVLLNLVG---ANPMS----------- 27
tr|C1BWD1|C1BWD1_ESOLU     ---MISNIQFC-------CLSVLVLLNLVG---AKPVS----------- 25
tr|D2KXA3|D2KXA3_ANGJA     -----MISNIFIY------CISSLLFLNLVG---GKPVS---------- 25
tr|B3DJG2|B3DJG2_DANRE     ......MTANISVF............CVSSLLLNLVG.....AKPVS...... 25
tr|Q1XGY8|Q1XGY8_9ACTI     ---MVSRLTVY-------CALFIIVLSQVS---AKPVS----------- 25
sp|Q8AXR2|ANFC2_ONCMY      ...ML...YPA..........LLCAALLLIAPLGHTEGRTLYPSPD...... 30
sp|Q8AXR3|ANFC1_ONCMY      ...ML...YPA..........LLCAALLLIAPLGHTEGRTLHPSPD...... 30
tr|C1BKS8|C1BKS8_OSMMO     ---ML--CPV-------LLCATLVLLPPLELSEGRALHPSPE-------- 30
tr|Q80SE7|Q80SE7_OREMO     -----ML--CPV-------LLCAALLLLTPLEITEARALHPSPD------ 30
tr|C3KH23|C3KH23_ANOFI     ---ML--CPV-------LLCATLLLLTPLEITEARALHPPPD-------- 30
sp|Q8AYR6|ANFC1_ORYLA      ---ML--CPV-------LLCATLLLLTPFEVTEARALHPSAD-------- 30
sp|Q805D6|ANFC1_TAKRU      ---ML--CPA-------LLCAALLLLTPVEITDARALQQPSD-------- 30
sp|P18145|ANFC_ANGJA       ---MM--CKA-------LVFAVLLLAVPLERADSRALRTPVD-------- 30
tr|Q1XGY9|Q1XGY9_9ACTI     ----MMGSCSAPLLTGHRILCLFLLMASSLSPIHSRAFRSFP-------- 38
tr|A9CDT5|A9CDT5_CHICK     MLGLPA-----------WPCSLFLLLVLLSASVQAMSSSGQR-------- 31
```

FIG. 15B
Multiple Alignment of C-Type Natriuretic Peptides from Various Species

```
sp|Q8AYR5|ANFC2_ORYLA    ------------------------------------------
sp|Q805D5|ANFC2_TAKRU    ------------------------------------------
sp|Q76KW6|ANFC_ACITR     ------------------------------------------
sp|Q61839|ANFC_MOUSE     ------------------------------------------
tr|Q544K5|Q544K5_MOUSE   ------------------------------------------
tr|Q8VHG9|Q8VHG9_NOTAL   ------------------------------------------
sp|P55207|ANFC_RAT       ------------------------------------------
sp|P55206|ANFC_BOVIN     ------------------------------------------
sp|P56283|ANFC_SHEEP     ------------------------------------------
sp|P18104|ANFC_PIG       ------------------------------------------
sp|P23582|ANFC_HUMAN     ------------------------------------------
sp|P84715|ANF39_ORNAN    ------------------------------------------
tr|Q9QZ96|Q9QZ96_CAVPO   ------------------------------------------
sp|Q80017|ANFC4_ORYLA    ------------------------------------------
sp|Q805D3|ANFC4_TAKRU    ------------------------------------------
tr|C1BXI5|C1BXI5_ESOLU   ------------------------------------------
tr|D2KXA5|D2KXA5_ANGJA   ------------------------------------------
tr|Q1XGY7|Q1XGY7_9ACTI   ------------------------------------------
sp|P40756|ANFD_RANCA     ------------------------------------------
sp|P0C7P5|BNP_TRIFL      --------------SPPIS----------------------- 38
sp|P0C7P6|BNP_TRIGA      ---------------SPPISPLLVP-------------PPPFPPEWPPP- 53
sp|Q6LEM5|BNP1_BOTJA     ----------WP--GPNIPPLKVQQWAQGGWPRPGPEIPPLTVQQWAQN- 69
sp|Q9PW56|BNP2_BOTJA     ----------WPRPGPEIPPLKVQQWAQGGWPRPGPEIPPLTVQQWAQN- 72
sp|P68515|BNP_BOTIN      ----------WPRPGPEIPPLKVQQWAQGGWPRPGPEIPPLTVQQWAQN- 72
sp|Q90Y12|BNP_CRODU      ------------------------------------------QRWP--- 34
sp|Q2PE51|BNP_CRODO      ------------------------------------------QRWP--- 34
sp|B0VXV8|BNP_SISCA      ------------------------------------------QNWPG-- 35
sp|Q27J49|BNP_LACMU      ----------KGWPFRPQIPPLVVQQWSQKPWP-PGHHIPPVVVQEWPF-- 69
sp|P01021|BNP_AGKHA      PRLVVQQWSQCLPPGPPIPRLVVQQWSQG-LP-PGPPIPPLVVQQWSQGL 87
sp|Q09GK2|VNP_PH1OL      ------------------------------------------
tr|D1MZV3|D1MZV3_RHATT   ------------------------------------------
tr|Q7T1M4|Q7T1M4_BOTJR   -----------------------------------GPPPG- 39
tr|Q402A2|Q402A2_PETMA   ------------------------------------------
tr|Q402A3|Q402A3_LAMJA   ------------------------------------------
tr|Q402A1|Q402A1_9PETR   ------------------------------------------
sp|P21805|ANFC_CHICK     ------------------------------------------
tr|A9CDT6|A9CDT6_CHICK   ------------------------------------------
sp|P20968|ANFC_RANCA     ------------------------------------------
sp|P55208|ANFC_TRISC     ------------------------------------------
sp|P23259|ANFC_SCYCA     ------------------------------------------
sp|P41313|ANFC_SQUAC     ------------------------------------------
tr|Q2MH72|Q2MH72_9CHON   ------------------------------------------
tr|Q2MH73|Q2MH73_9CHON   ------------------------------------------
tr|Q2MH71|Q2MH71_9CHON   ------------------------------------------
tr|Q2MH74|Q2MH74_DASAK   ------------------------------------------
tr|Q2PF87|Q2PF87_CALMI   ------------------------------------------
sp|Q80015|ANFC3_ORYLA    ------------------------------------------
tr|Q4ADV1|Q4ADV1_ORYLA   ------------------------------------------
sp|Q805D4|ANFC3_TAKRU    ------------------------------------------
tr|C0H7B0|C0H7B0_SALSA   ------------------------------------------
tr|C1BWD1|C1BWD1_ESOLU   ------------------------------------------
tr|D2KXA3|D2KXA3_ANGJA   ------------------------------------------
tr|B3DJ52|B3DJ52_DANRE   ------------------------------------------
tr|Q1XGY8|Q1XGY8_9ACTI   ------------------------------------------
sp|Q8AXR2|ANFC2_ONCMY    ------------------------------------------
sp|Q8AXR3|ANFC1_ONCMY    ------------------------------------------
tr|C1BKS8|C1BKS8_OSMMO   ------------------------------------------
tr|Q80SE7|Q80SE7_OREMO   ------------------------------------------
tr|C3KH23|C3KH23_ANOFI   ------------------------------------------
sp|Q8AYR6|ANFC1_ORYLA    ------------------------------------------
sp|Q805D6|ANFC1_TAKRU    ------------------------------------------
sp|P18145|ANFC_ANGJA     ------------------------------------------
tr|Q1XGY9|Q1XGY9_9ACTI   ------------------------------------------
tr|A9CDT5|A9CDT5_CHICK   ------------------------------------------
```

FIG. 15C

Multiple Alignment of C-Type Natriuretic Peptides from Various Species

```
sp|Q8AYR5|ANFC2_ORYLA    ------------------------------------------------
sp|Q805D5|ANFC2_TAKRU    ------------------------------------------------
sp|Q76KW6|ANFC_ACITR     ------------------------------------------------
sp|Q61839|ANFC_MOUSE     ------------------------------------------------
tr|Q544K5|Q544K5_MOUSE   ------------------------------------------------
tr|Q8VHG9|Q8VHG9_NOTAL   ------------------------------------------------
sp|P55207|ANFC_RAT       ------------------------------------------------
sp|P55206|ANFC_BOVIN     ------------------------------------------------
sp|P56283|ANFC_SHEEP     ------------------------------------------------
sp|P18104|ANFC_PIG       ------------------------------------------------
sp|P23582|ANFC_HUMAN     ------------------------------------------------
sp|P84715|ANF39_ORNAN    ------------------------------------------------
tr|Q9QZ96|Q9QZ96_CAVPO   ------------------------------------------------
sp|Q800I7|ANFC4_ORYLA    ------------------------------------------------
sp|Q805D3|ANFC4_TAKRU    ................................................
tr|C1BXI5|C1BXI5_ESOLU   ------------------------------------------------
tr|D2KXA5|D2KXA5_ANGJA   ................................................
tr|Q1XGY7|Q1XGY7_9ACTI   ................................................
sp|P40756|ANFD_RANCA     ------------------------------------------------
sp|P0C7P5|BNP_TRIFL      ········PLSAQQWMPEGRPPHP··IPPLSVQQWSQGRP········  68
sp|P0C7P6|BNP_TRIGA      ----HHIPPLSVQKFPPGWKPTHPHHIPPLEVQQWSQGGP------- 89
sp|Q6LEM5|BNP1_BOTJA     WPHPQIPPLTVQQWAQ-GRAPGPP-IPPLTVQQWAQGRAPHPPIPPAPLQ 117
sp|Q9PW56|BNP2_BOTJA     WPHPQIPPLTVQQWAQWGRPPGPP-IPPLTVQQWAQARPPHPPIPPAPLQ 121
sp|P68515|BNP_BOTIN      WPHPQIPPLTVQQWAQLGPPPRPQ-IPPLEVQQWAQGRAPHPPIPPAPLQ 121
sp|Q90Y12|BNP_CRODU      --------------------HLE-IPPLVVQNWK-------------- 47
sp|Q2PE51|BNP_CRODO      --------------------HLE-IPPLVVQNWK-------------- 47
sp|B0VXV8|BNP_SISCA      ----PKVPPLVVQQWSQK--WPHPQ-IPPLVVQNWK------------ 64
sp|Q2J749|BNP_LACMU      --GHHIPPLVVQQWSQKEWPPGHH-IPPLVVQKWDF------------ 102
sp|P01021|BNP_AGKHA      PPRPKIPPLVVQQWSQG-LPPRPK-IPPLVVQKWDP------------ 121
sp|Q09GK2|VNP_PH1OL      ------------------------------------------------
tr|D1MZV3|D1MZV3_RHATT   ------------------------------------------------
tr|Q7T1M4|Q7T1M4_BOTJR   ----PP1PPLTVQQWAQAR-PPHPP-1PPAPLQKWAPVQK-------- 73
tr|Q402A2|Q402A2_PETMA   ................................................
tr|Q402A3|Q402A3_LAMJA   ------------------------------------------------
tr|Q402A1|Q402A1_9PETR   ................................................
sp|P21805|ANFC_CHICK     ------------------------------------------------
tr|A9CDT6|A9CDT6_CHICK   ................................................
sp|P20968|ANFC_RANCA     ------------------------------------------------
sp|P55208|ANFC_TRISC     ------------------------------------------------
sp|P23259|ANFC_SCYCA     ------------------------------------------------
sp|P41313|ANFC_SQUAC     ------------------------------------------------
tr|Q2MH72|Q2MH72_9CHON   ------------------------------------------------
tr|Q2MH73|Q2MH73_9CHON   ------------------------------------------------
tr|Q2MH71|Q2MH71_9CHON   ------------------------------------------------
tr|Q2MH74|Q2MH74_DASAK   ------------------------------------------------
tr|Q2PF87|Q2PF87_CALMI   ------------------------------------------------
sp|Q800I8|ANFC3_ORYLA    ------------------------------------------------
tr|Q4ADV1|Q4ADV1_ORYLA   ------------------------------------------------
sp|Q805D4|ANFC3_TAKRU    ------------------------------------------------
tr|C0H7B0|C0H7B0_SALSA   ------------------------------------------------
tr|C1BWD1|C1BWD1_ESOLU   ------------------------------------------------
tr|D2KXA3|D2KXA3_ANGJA   ------------------------------------------------
tr|B3DJG2|B3DJG2_DANRE   ------------------------------------------------
tr|Q1XGY8|Q1XGY8_9ACTI   ------------------------------------------------
sp|Q8AXR2|ANFC2_ONCMY    ................................................
sp|Q8AXR3|ANFC1_ONCMY    ................................................
tr|C1BKS8|C1BKS8_OSMMO   ------------------------------------------------
tr|Q805E7|Q805E7_OREMO   ------------------------------------------------
tr|C3KH23|C3KH23_ANOFI   ------------------------------------------------
sp|Q8AYR6|ANFC1_ORYLA    ------------------------------------------------
sp|Q805D6|ANFC1_TAKRU    ------------------------------------------------
sp|P18145|ANFC_ANGJA     ------------------------------------------------
tr|Q1XGY9|Q1XGY9_9ACTI   ------------------------------------------------
tr|A9CDT5|A9CDT5_CHICK   ------------------------------------------------
```

FIG. 15D
Multiple Alignment of C-Type Natriuretic Peptides from Various Species

```
sp|Q8AYR5|ANFC2_ORYLA          --------------------EQVLKSLFGPHLTSL--------------------IL  47
sp|Q805D5|ANFC2_TAKRU          --------------------AQVLRALFGARLSSI--------------------IS  47
sp|Q76KW6|ANFC_ACITR           --------------------KSQLAGLFGAEVAAL--------------------LE  57
sp|Q61839|ANFC_MOUSE           --------------------PKVPRTPPGEELADS----------------QAAG  47
tr|Q544K5|Q544K5_MOUSE         --------------------PKVPRTPPGEELADS----------------QAAG  47
tr|Q8VHG9|Q8VHG9_NOTAL         --------------------PKVPRTPFGEELADS----------------QAAG  47
sp|P55207|ANFC_RAT             --------------------PKVPRTPFGEELAEP----------------QAAG  47
sp|P55206|ANFC_BOVIN           --------------------PKVPRTPGGEEVAEP----------------QAAG  47
sp|P56283|ANFC_SHEEP           --------------------PKVPRTPPGEEVAEP----------------QAAG  47
sp|P18104|ANFC_PIG             --------------------PKVPRTPPGEEVAEP----------------QAAG  47
sp|P23582|ANFC_HUMAN           --------------------PKVPRTPPAEELAEP----------------QAAG  47
sp|P84715|ANF39_ORNAN          -------------------PQVPRSP-GDEASEA----------------VAAN  46
tr|Q9Q296|Q9Q296_CAVPO         ----------------------------------------------------------
sp|Q800I7|ANFC4_ORYLA          --------------------QKSLRSLLGEELAEF----------------LESG  48
sp|Q805D3|ANFC4_TAKRU          --------------------QKSFRSLLGEELAEF----------------LESE  48
tr|C1BXI5|C1BXI5_ESOLU         --------------------QKSLRNLLGEELSEF----------------LASG  48
tr|D2KXA5|D2KXA5_ANGJA         --------------------EKSLRNLLGEELSEY----------------LASG  48
tr|Q1XGY7|Q1XGY7_9ACTI         --------------------QKSLRNLLGEELSAY----------------LTSD  48
sp|P40756|ANFD_RANCA           --------------------QKSLRALLGEELASY----------------LVSG  48
sp|P0C7P5|BNP_TRIFL            ----RSEVPPVVVQPRESPAGGTTAFREELSPG----------------PEAASG  103
sp|P0C7P6|BNP_TRIGA            ----RSEL------VQPRESPAGGTTAFREELSLG----------------PEAASG  120
sp|Q6LEM5|BNP1_BOTJA           KWAPLQKWAPLLQPRESPASGTTALREELSLG----------------PEAASG  155
sp|Q9PW56|BNP2_BOTJA           KWAPVQKWAPLLQPRESPASGTTALREELSLG----------------PEAASG  159
sp|P68515|BNP_BOTIN            KWAPVQKWAPLLQPRESPASGTTALREELSLG----------------PEAASG  159
sp|Q9OY12|BNP_CRODU            ----------SPTQFQARSPAGGTTALREELSLG---------------PEAALD  78
sp|Q2PF51|BNP_CRODO            ----------SPTQLQARSPAGGTTALREELSLG---------------PEAALD  78
sp|B0VXV8|BNP_SISCA            ---------SPTQLQPRESPAGGTIALREELSLG---------------PDAALD  95
sp|Q27J49|BNP_LACMU            ----PPI-SPPLLKPHESPAGGTTALREELSLG---------------PEAALD  136
sp|P01021|BNP_AGKHA            ----PPVSPPLLLQPHESPAGGTTALREELSLG---------------PEAASG  156
sp|Q09GK2|VNP_PHIOL            --------------------LRKAPAGGTTAWRRELTEQ--------------PEGASR  55
tr|D1MZV3|D1MZV3_RHATT         ---------------LRKAPAGGTTALQRQLTEQQQQQQ--------QAEGSSG  59
tr|Q7T1M4|Q7T1M4_BOTJR         -WAPVQKWAPLLQPRESPAGGTTALREELSLG----------------PEAASG  110
tr|Q402A2|Q402A2_PETMA         --------------SGGSEPWEGG-FLPRVSSSSSSSSG---------EVEPLAE  30
tr|Q402A3|Q402A3_LAMJA         -------------DAGSEPWEGG-FLPRISSSSSSS-----------AERLAD  60
tr|Q402A1|Q402A1_9PETR         -----------DTNSEPWEGGSLLPSLPSQGEGD---------SHPLS-  63
sp|P21805|ANFC_CHICK           ----------------------------------------------------------
tr|A9CDT6|A9CDT6_CHICK         --------------------SLQSLSMLLDEE--------------------L  39
sp|P20968|ANFC_RANCA           --------------------SLQNLSRLLEDN--------------------F  41
sp|P55208|ANFC_TRISC           --------------------DDSLQTLSRLLEDE-----------------Y  40
sp|P23259|ANFC_SCYCA           --------------------DDSLQTLSRLLEDE-----------------Y  19
sp|P41319|ANFC_SQUAC           --------------------DDSLQVLSRLLEDE-----------------Y  40
tr|Q2MH72|Q2MH72_9CHON         --------------------DDSLQALTRLLEDE-----------------Y  40
tr|Q2MH73|Q2MH73_9CHON         --------------------DDSLQALTRLLEDE-----------------Y  40
tr|Q2MH71|Q2MH71_9CHON         --------------------DDSLQALTRLLEDE-----------------Y  40
tr|Q2MH74|Q2MH74_DASAK         --------------------DDSLQALTRLLEDE-----------------Y  40
tr|Q2PF87|Q2PF87_CALMI         --------------------VDSLQTLSRLLEDE-----------------Y  43
sp|Q800I8|ANFC3_ORYLA          --------------------ELQNLERLL---------------------- 32
tr|Q4ADV1|Q4ADV1_ORYLA         --------------------ELQNLERLL---------------------- 32
sp|Q805D4|ANFC3_TAKRU          ----------DLQILEFFLSSLEEQEEMQEEVQEKVQEQQEEVQ  59
tr|C0H7B0|C0H7B0_SALSA         --------------------NLQSLKQLLEEE--------------------SH  41
tr|C1BWD1|C1BWD1_ESOLU         --------------------NLQSLKEFLEE--------------------SN  38
tr|D2KXA3|D2KXA3_ANGJA         --------------------SLQSLKELLEEE-------------------SN  39
tr|B3DJJ2|B3DJJ2_DANRE         --------------------SLQSLKQLLDEE-------------------VN  39
tr|Q1XGY8|Q1XGY8_9ACTI         --------------------SLQSFAQLLEDE-------------------SN  39
sp|Q8AXR2|ANFC2_ONCMY          --------------------AIQFVEQFLDR--------------------YN  43
sp|Q8AXR3|ANFC1_ONCMY          --------------------AIQFVEQFLDR--------------------YN  43
tr|C1BKS8|C1BKS8_OSMMO         --------------------GLQFVEQFLER--------------------CT  43
tr|Q805E7|Q805E7_OREMO         --------------------AVQFVEQFLER--------------------YN  43
tr|C3KH23|C3KH23_ANOFI         --------------------AVQFMEQFLER--------------------YN  43
sp|Q8AYR6|ANFC1_ORYLA          --------------------AVQFMEQFLDR--------------------YN  43
sp|Q805D6|ANFC1_TAKRU          --------------------AAQFMEQFLES--------------------YN  43
sp|P18145|ANFC_ANGJA           --------------------AIQFVEQFLEH--------------------YN  43
tr|Q1XGY9|Q1XGY9_9ACTI         --------------------LQFLSTLLEKE--------------------YG  51
tr|A9CDT5|A9CDT5_CHICK         --------------------LQVLLSQLLPS--------------------DS  44
```

FIG. 15E
Multiple Alignment of C-Type Natriuretic Peptides from Various Species

```
sp|Q8AYR5|ANFC2_ORYLA    APPTSNDS--TEGSSGSPEPP----------------TPSEAPVLIH--- 76
sp|Q805D5|ANFC2_TAKRU    TPVNTDDI·-AELLPRRPGPPR············SFGASPGALRGLTR-- 81
sp|Q76KW6|ANFC_ACITR     DAGAADGSSGEEAALSQRAPPS-------------IRALHPRSGRLGLRDD 95
sp|Q61839|ANFC_MOUSE     GNQKKGDKTPGSGGANLKGDRS---------------------RLLRDLR 76
tr|Q544K5|Q544K5_MOUSE   GNQKKGDKTPGSGGANLKGDRS---------------------RLLRDLR 76
tr|Q8VHG9|Q8VHG9_NOTAL   GNQKKGDKTPGGGGANLKGDRSRLLKGDKTPGGGGANLKGDRSRLLRDLR 97
sp|P55207|ANFC_RAT       GNQKKGDKTPGGGGANLKGDRS---------------------RLLRDLR 76
sp|P55206|ANFC_BOVIN     GGQKKGDKTPGGGGANLKGDRS---------------------RLLRDLR 76
sp|P56283|ANFC_SHEEP     GGQKKGDKTPGGGGANLKDDRS---------------------RLLRDLR 76
sp|P18104|ANFC_PIG       GGQKKGDKTPGGGGANLKGDRS---------------------RLLRDLR 76
sp|P23582|ANFC_HUMAN     GGQKKGDKAPGGGGANLKGDRS---------------------RLLRDLR 76
sp|P84715|ANF39_ORNAN    GGGKKGDKEP--------KGDRP---------------------RLLRELR 68
tr|Q9QZ96|Q9QZ96_CAVPO   --------------------------------------------------
sp|Q80017|ANFC4_ORYLA    ENENRLDDVRSRM-----------------------------RLLRDLR 68
sp|Q805D3|ANFC4_TAKRU    EKERRLDAVRSRL·····························RLLRDLR 68
tr|C1BXI5|C1BXI5_ESOLU   EPERRLDTVRSRV-----------------------------RLLRDLR 68
tr|D2KXA5|D2KXA5_ANGJA   ERERNLESARS-------------------------------RLLRDLR 66
tr|Q1XGY7|Q1XGY7_9ACTI   EQESGSERLRSRA-----------------------------RLLRDLR 68
sp|P40756|ANFD_RANCA     ERGERSIDPKTRA-----------------------------RLLRDIR 68
sp|P0C7P5|BNP_TRIFL      ················PAAPHRLPKSKG·······ASATS·AASRPMRDLR 130
sp|P0C7P6|BNP_TRIGA      ----------------PAAPQRLPKRKG-------ASATS-AASRSMRDLR 147
sp|Q6LEM5|BNP1_BOTJA     VPSAGAEVGRSGGK-APAAPHRLSKSKG------AAAAT-----RPMRDLR 193
sp|Q9PW56|BNP2_BOTJA     VPSAGAEVGRSGGK-APAAPHRLSKSKG------AAATS-AASRPMRDLR 201
sp|P68515|BNP_BOTIN      VPSAGAEVGRSGGK-APAAPHRLSKSKG------AAATS-AASRPMRDLR 201
sp|Q90Y12|BNP_CRODU      TPPAGPDGGPRGSKAAAAAPQRLSKSKG------ASATS-AASR---DLR 118
sp|Q2PE51|BNP_CRODO      TPPAGPDGGPRGSKAAAAAPQRLSKSKG------ASATS-AASR---DLR 118
sp|B0VXV8|BNP_SISCA      TPPAGPDVGPRGSK-AAAAPQRLSKSKG------ASATS-TASRPMRDLR 137
sp|Q27J49|BNP_LACMU      TPPAGPDVGPRGSK-APAAPHRLPKSKG------AAATS-AASRPMRDLR 178
sp|P01021|BNP_AGKHA      PAAAGADGGRSGSK-APAALHRLSKSKG------ASATSASASRPMRDLR 199
sp|Q09GK2|VNP_PH1OL      PAAGGGGGGGRSGSKAANAAPTAPKSKGG-----AAAAAAAPLMRDLR 100
tr|D1MZV3|D1MZV3_RHATT   PAAGGGGG--RSGSKTANAAPTAPKSKG------AAASAASRLLRDLR 99
tr|Q7TIM4|Q7TIM4_BOTJR   VPSAGAEGRAQRLEGARCTPSAVEEQRGG------GDLGGVAADAGLAPRR 155
tr|Q402A2|Q402A2_PETMA   VTATGGVSGGVSGGVLGGTPWVGPRGEQ···············RPSRGLA 65
tr|Q402A3|Q402A3_LAMJA   ATVTR-EGGGGGGGDDGTSWFLFQGPPG------------PPRSSRGLA 97
tr|Q402A1|Q402A1_9PETR   ···············AEGG·······PWFRGSGPQ················RSSRGIG 83
sp|P21805|ANFC_CHICK     --------------------------------------------------
tr|A9CDT6|A9CDT6_CHICK   QHPLVSEERDREQDGSIPVGAF--------DQEDAEFQWTRNTRD------ 76
sp|P20968|ANFC_RANCA     ERSFGSDEADQQL······VPTDSL······DQLDPELQWNKKRLE······ 75
sp|P55208|ANFC_TRISC     GHYLPSDELNNEAQEMSPAASLPEFNADQSDLELFWDRESRE-------- 82
sp|P23259|ANFC_SCYCA     GHYLPSDELNNEAEEMSPAASLPELNADQSDLELFWERESRE-------- 81
sp|P41313|ANFC_SQUAC     GHFN-SEELMNEAQEISPAASLPDLNTDQSDLELFWDRESRE-------- 81
tr|Q2MH72|Q2MH72_9CHON   GQYFTTEDLNNEAPEIPPAASLPDLNTDQSDLDLSWDRESRE-------- 82
tr|Q2MH73|Q2MH73_9CHON   GQYFTTEDLNNEAPEIPPAASLPDLNTDQSDLDLSWDRESRE-------- 82
tr|Q2MH71|Q2MH71_9CHON   GQYFTSEDLNNEAPEIPPAASLPDLNTDQPDFDLSWDRESRE-------- 82
tr|Q2MH74|Q2MH74_DASAK   GQYFTSEDLNNEAPEMSPAASLPDLNTEQSETDLFWDRESRE-------- 82
tr|Q2PF87|Q2PF87_CALMI   GPYLSSEDSDMDAEEASRAGTLRDLNLDQADMDLLWDRDARD-------- 85
sp|Q80015|ANFC3_ORYLA    ---QDQLSSTEHPEE---DRLD------RTREEPQLGG------------- 58
tr|Q4ADV1|Q4ADV1_ORYLA   ---QDQLSSTEHPEE---DRLD------RTREEPQLGG------------- 58
sp|Q805D4|ANFC3_TAKRU    EKVGEQQEEVQEQQEEVQEQQE-----EQQEEVQERGRGIGDVLLRAQLD 104
tr|C0H7B0|C0H7B0_SALSA   VPYYASDEMGVDGKDLNTEN--------IAEEVPFWDSEDAR--------- 75
tr|C1BWD1|C1BWD1_ESOLU   VPYYGGEESEVDDKDLNTEKEA------FTGEVVQPWLTEDR--------- 74
tr|D2KXA3|D2KXA3_ANGJA   APYLDSEEAEVQGKEMNAENAA------FTKASLESWDPNSR--------- 75
tr|B3DJG2|B3DJG2_DANRE   KPFFESQFSVMEQKDATAEKSA--------LDERAEQIWESDAR------- 75
tr|Q1XGY8|Q1XGY8_9ACTI   HPYVDSDDDTRGGLDVSAEIAT-----DDSEADIPWNEKFRDL-------- 77
sp|Q8AXR2|ANFC2_ONCMY    DLT···LDDLENLVSSQPEEPSS················AFTSGVKIAEYPKW 77
sp|Q8AXR3|ANFC1_ONCMY    DLT···LDDLENLVSSQPEEPSS················AFTSGVKVAEYPKW 77
tr|C1BKS8|C1BKS8_OSMMO   DLLN-LDDLENAGSNQPEEPS--------------DYANGVKVAEYPKW 77
tr|Q805E7|Q805E7_OREMO   DLLT-LDDLENMLNSQAEEQS------------TLSSGSKAVEYPKW 77
tr|C3KH23|C3KH23_ANOFI   DLLT-LDDLENLLNSQPEEQS---------------TFSSGVKAAEYPKW 77
sp|Q8AYR6|ANFC1_ORYLA    DLLT-LDDLENLLNTQPEEQS---------------TLSSGGVKIAEYPKW 77
sp|Q805D6|ANFC1_TAKRU    DLLT-LDDLENMLNSHPEEQS--------------NLSS-SKADEYPKW 76
sp|P18145|ANFC_ANGJA     DLLN-IDDLENQTGDQLESPQ--------------PLSSGLKVAEYPKW 77
tr|Q1XGY9|Q1XGY9_9ACTI   NLQSGPVNIHNVSSEQYEDPQ---------------PWADVSSVSKEQIW 86
tr|A9CDT5|A9CDT5_CHICK   ESMPAEEDMKEGSSSEPQLLSP--------------FLPLLFSRAR---- 76
```

FIG. 15F
Multiple Alignment of C-Type Natriuretic Peptides from Various Species

```
sp|Q8AYR5|ANFC2_ORYLA      ------GDRGTASQILRSFLRQRF----------KTRRWG--RKPMVAG- 107
sp|Q805D5|ANFC2_TAKRU      ..........GSEG.GSRFLLDFLQQQS........KTTRRG..RSSMVGG- 111
sp|Q76KW6|ANFC_ACITR       LEAEPPAENKPRRRLLKDFMSSR----------KMFRGR--TKKMQQG- 131
sp|Q61839|ANFC_MOUSE       VDTKSR---AAWARLLHEHPN----------ARKYKG--GNKKGLS- 107
tr|Q544K5|Q544K5_MOUSE     VDTKSR---AAWARLLHEHPN----------ARKYKG--GNKKGLS- 107
tr|Q8VHG9|Q8VHG9_NOTAL     VDTKSR---AAWARLLHEHPN----------APKNKG--GNKKGLS- 128
sp|P55207|ANFC_RAT         VDTKSR---AAWARLLHEHPN----------ARKYKG--GNKKGLS- 107
sp|P55206|ANFC_BOVIN       VDTKSR---AAWFRLLHEHPN----------ARKYKG--GNKKGLS- 107
sp|P56283|ANFC_SHEEP       VDTKSR---AAWFRLLHEHPN----------ARKYKG--GNKKGLS- 107
sp|P18104|ANFC_PIG         VDTKSR---AAWARLLHEHPN----------ARKYKG--GNKKGLS- 107
sp|P23582|ANFC_HUMAN       VDTKSR---AAWARLLQEHPN----------ARKYKG--GNKKGLS- 107
sp|P84715|ANF39_ORNAN      LDTRSRGSRGVWTRLLHDHPN----------PRKYKP--ANKKGLS- 102
tr|Q9QZ96|Q9QZ96_CAVPO     --------------------N-----------ARKYKG--GNKKGLS- 14
sp|Q80017|ANFC4_ORYLA      VDTRAR---GMWARLLNDQPA----------SRRRKS--GSKKGGST 100
sp|Q805D3|ANFC4_TAKRU      MDTRAR.....GVWARLLNDQPV..........PRRRKT..GIKKGGS- 99
tr|C1BXI5|C1BXI5_ESOLU     MDTRAK---GMWARLLNDQPN----------APRRKQ--NSKKGTV- 99
tr|D2KXA5|D2KXA5_ANGJA     LNTRAR..-GMWSRIMKNDQPA............SRKQKT..GVKKGAST 98
tr|Q1XGY7|Q1XGY7_9ACTI     LDIRAK.....AAWARLLNDHPN..........PRKSKG..INKKGLS- 99
sp|P40756|ANFD_RANCA       ADTRSR---AAWFRLLNEHPN----------SRKIKG--INKKGTS- 99
sp|P0C7P5|BNP_TRIFL        TDGKQERQKWG.RMVQPDHHAAPGGGGGGGG.ARRMKG....LAKKAMG- 174
sp|P0C7P6|BNP_TRIGA        ADGKQARQKWG--RMVQPDHHAAPGGGGGGGG--ARRLKG--LAKKAVG- 191
sp|Q6LEM5|BNP1_BOTJA       PDGKQARQNWG--RMAHHDHHAAAGGGGGGGGG-ARRLKG--LAKKGAA- 237
sp|Q9PW56|BNP2_BOTJA       PDGKQARQNWG--RMVHHDHHAAVGGGGGGGGGGARRLKG--LAKKGAA- 246
sp|P68515|BNP_BOTIN        PDGKQARQNWG--RMVHHDHHAAVGGGGGGGGGGARRLKG--LAKKGAA- 246
sp|Q90Y12|BNP_CRODU        TDGKQARQNWG--RLVSPDHHSAAGGGCGGGGG-ARRLKG--LAKKRAG- 162
sp|Q2PE51|BNP_CRODO        TDGKQARQNWG--RLVSPDHHSAAGGGGGGGGG-ARRLKG--LAKKRAG- 162
sp|B0VXV8|BNP_SISCA        TDGKQARQNWG---RMLNPDHHSAPGGGGGGGGGGARRLKG--LAKKRAG- 182
sp|Q27J49|BNP_LACMU        TDGKQARQNWG--RMMKPDHHAVGGGG---GGGG-ARRLKG--LAKKRVG- 220
sp|P01021|BNP_AGKHA        TDGKQARQNWA--RMVNPDHHAVGGCCCGGGGGARRLKG--LVKKGVA- 244
sp|Q09GK2|VNP_PH1OL        PDSKQARAAWG--RMVHPEHHAGGGGGGGGGGGGASRRLKG--VAKKGLG- 145
tr|D1MZV3|D1MZV3_RHATT     PDGKQSRAAWG---RMVHPEHHAGGGGGGGGGG--SRRLKG--LPKKGLG- 142
tr|Q7TIM4|Q7TIM4_BOTJR     QAGAAELGPDGAPRFPRPPRSGRRAAAAAAAERGARRLKG--LAKKGAA- 202
tr|Q402A2|Q402A2_PETMA     EGGSQVSG.GVWQRLFKDFVSN...........QRRFRG...RTKKGKG- 99
tr|Q402A3|Q402A3_LAMJA     EGGSQVSG-GVWQRLFKDFVSN----------QRRFRG--RTKKGKG- 131
tr|Q402A1|Q402A1_9PETR     .GGSQVSG..EVWQRLFKDFVSN...........QRRFRG...RTKKGKG- 116
sp|P21805|ANFC_CHICK       ............................................GLS- 3
tr|A9CDT6|A9CDT6_CHICK     QPASTSTADSDVQRILSDLLGL.............PQRYQN..RSKKGLS- 111
sp|P20968|ANFC_RANCA       QGDSPHVNEMILQQELKDPVGT.............SRRYRQ..RNKKGYS- 110
sp|P55208|ANFC_TRISC       IGGRPFRQEAVLARLLKDLSNN----------PLRFRG--RSKKGPS- 117
sp|P23259|ANFC_SCYCA       IGGRPFRQEAVLARLLKDLSNN............PLRFRG..RSKKGPS- 96
sp|P41313|ANFC_SQUAC       IGGRSFRQEALLARLLQDLSNN----------PLRFRG--RSKKGPS- 116
tr|Q2MH72|Q2MH72_9CHON     IASR-----PILARILKDLSNN----------PLRFRG--RSKKGPS- 112
tr|Q2MH73|Q2MH73_9CHON     IASR-----PILARILKDLSNN----------PLRFRG--RSKKGPS- 112
tr|Q2MH71|Q2MH71_9CHON     IASR-----PILARILKDLSNN----------PLRFRG--RSKKGPS- 112
tr|Q2MH74|Q2MH74_DASAK     IASR-----PILARILKDLNKI----------PLRFRG--RSKKGPS- 112
tr|Q2PF87|Q2PF87_CALMI     IGGRSFQHDGLLLRLLKDLTIS----------PLRFRG--RSKKGPS- 120
sp|Q80018|ANFC3_ORYLA      SSSREAADESALTRLFADLLRT----------SKRSWG--RYKKGGM- 93
tr|Q4ADV1|Q4ADV1_ORYLA     SSSREAADESALTRLFADLLRT----------SKRSWG--RYKKGGM- 93
sp|Q805D4|ANFC3_TAKRU      SSTWALQKDDVLMRLFKDLLRT----------SKRSRS--RYKKGGL- 139
tr|C0H7B0|C0H7B0_SALSA     -NSALTGKEDVIARLLNDIMTT----------FKRSWS--RFKKGCL- 109
tr|C1BWD1|C1BWD1_ESOLU     --SALTGKENAVARLLSDIMTT----------FKRSWG--RFKKGGM- 107
tr|D2KXA3|D2KXA3_ANGJA     -DAALSSNENALVRLLNDILSS----------SKRSWS--RFKKGGL- 109
tr|B3DJG2|B3DJG2_DANRE     -NSALAGKYGMFERLLGDLLST----------SKRSWS.-RFKKGDL- 109
tr|Q1XGY8|Q1XGY8_9ACTI     -QSRQAAHSSRMKLLKEDILTS----------SGRSKD--RSKKSGL- 131
sp|Q8AXR2|ANFC2_ONCMY      ADIP.AQGDSTWLRLLKGTLAN............QKRAVT.DRSRRGWN- 112
sp|Q8AXR3|ANFC1_ONCMY      ADIP.AQGDSTWLRLLKGTLAN............QKRAVM.DRSRRGWN- 112
tr|C1BKS8|C1BKS8_OSMMO     ADLPAAQEDSAWLRLLKAALAN----------QKRAEP-DRSRRAWN- 113
tr|Q805E7|Q805E7_OREMO     ADAQTQPE-TPWLRLLKGALAN----------QKRAEP-DRSRRGWN- 112
tr|C3KH23|C3KH23_ANOFI     ADAQTQAE-TPWLRLLKGAVAN----------QKRAEP-DRSRRGWN- 112
sp|Q8AYR6|ANFC1_ORYLA      ADLQTQPE-TPWFRLLKGALTN----------QKRAEP-DRSRRGWN- 112
sp|Q805D6|ANFC1_TAKRU      AEAD-----TPWLRLLRGALAN----------QKRAEP-DRSRRGWN- 107
sp|P18145|ANFC_ANGJA       VDVPSQND-NTWFRLLRGALAN----------RKRALP-DRAKRGWN- 112
tr|Q1XGY9|Q1XGY9_9ACTI     GDEFPANE-NALYLLLRRAAAN----------RTWISA-DRVKKAWS- 121
tr|A9CDT5|A9CDT5_CHICK     ---------AAHPLLWRKALAS----------RKRALSGDWAWKAVP- 104
```

FIG. 15G
Multiple Alignment of C-Type Natriuretic Peptides from Various Species

```
sp|Q8AYR5|ANFC2_ORYLA      ----GGCFGMKMDRIGSISGLGC- 126 (SEQ ID NO: 31)
sp|Q805D5|ANFC2_TAKRU      ------RGCFGMKIDRIGSISGLGC- 130 (SEQ ID NO: 32)
sp|Q76KW6|ANFC_ACITR       ----RGCFGMKLDRIGSMSGLGC- 150 (SEQ ID NO: 33)
sp|Q61839|ANFC_MOUSE       ----KGCFGLKLDRIGSMSGLGC- 126 (SEQ ID NO: 34)
tr|Q544K5|Q544K5_MOUSE     ----KGCFGLKLDRIGSMSGLGC- 126 (SEQ ID NO: 35)
tr|Q8VHG9|Q8VHG9_NOTAL     ----KGCFGLKLDRIGSMSGLGC- 147 (SEQ ID NO: 36)
sp|P55207|ANFC_RAT         ----KGCFGLKLDRIGSMSGLGC- 126 (SEQ ID NO: 37)
sp|P55206|ANFC_BOVIN       ----KGCFGLKLDRIGSMSGLGC- 126 (SEQ ID NO: 38)
sp|P56283|ANFC_SHEEP       ----KGCFGLKLDRIGSMSGLGC- 126 (SEQ ID NO: 39)
sp|P18104|ANFC_PIG         ----KGCFGLKLDRIGSMSGLGC- 126 (SEQ ID NO: 40)
sp|P23582|ANFC_HUMAN       ----KGCFGLKLDRIGSMSGLGC- 126 (SEQ ID NO: 41)
sp|P84715|ANF39_ORNAN      ----KGCFGLKLDRIGSTSGLGC- 121 (SEQ ID NO: 42)
tr|Q9QZ96|Q9QZ96_CAVPO     ----KGCFGLKLDRIGSMSGLGC- 33  (SEQ ID NO: 43)
sp|Q80017|ANFC4_ORYLA      -SRSGCFGHKMDRIGTISGMGC- 121 (SEQ ID NO: 44)
sp|Q805D3|ANFC4_TAKRU      -SRSGCFGHKMDRIGTISGMGC- 120 (SEQ ID NO: 45)
tr|C1BXI5|C1BXI5_ESOLU     -PRSGCFGQKLDRIGTLSGMGC- 121 (SEQ ID NO: 46)
tr|D2KXA5|D2KXA5_ANGJA     PARGGCFGRKLDRISTLSGMGC- 120 (SEQ ID NO: 47)
tr|Q1XGY7|Q1XGY7_9ACTI     ---KGCFGLKLDRIGSMSGLGC- 118 (SEQ ID NO: 48)
sp|P40756|ANFD_RANCA       ---KGCFGLKLDRIGAMSGLGC- 118 (SEQ ID NO: 49)
sp|P0C7P5|BNP_TRIFL        ---KGCFGHKLDRIGSTSGLGC- 193 (SEQ ID NO: 50)
sp|P0C7P6|BNP_TRIGA        ---KGCFGLPLDRIGSMSGMGC- 210 (SEQ ID NO: 51)
sp|Q6LEM5|BNP1_BOTJA       ---KGCFGLKLDRIGTMSGLGC- 256 (SEQ ID NO: 52)
sp|Q9PW56|BNP2_BOTJA       ---KGCFGLKVDRIGTMSGLGC- 265 (SEQ ID NO: 53)
sp|P68515|BNP_BOTIN        ---KGCFGLKLDRIGTMSGLGC- 265 (SEQ ID NO: 54)
sp|Q90Y12|BNP_CRODU        ---NGCFGLKLDRIGSMSGLGC- 181 (SEQ ID NO: 55)
sp|Q2PE51|BNP_CRODO        ---NGCFGLKLDRIGSMSGLGC- 181 (SEQ ID NO: 56)
sp|B0VXV8|BNP_SISCA        ----SGCFGLKLDRIGSMSGLGC- 201 (SEQ ID NO: 57)
sp|Q27J49|BNP_LACMU        ---DGCFGLKLDRIGSMSGLGC- 239 (SEQ ID NO: 58)
sp|P01021|BNP_AGKHA        ---KGCFGLKLDRIGTMSGLGC- 263 (SEQ ID NO: 59)
sp|Q09GK2|VNP_PH1OL        ---KGCFGLKLDRIGSMSGLGC- 164 (SEQ ID NO: 60)
tr|D1MZV3|D1MZV3_RHATT     ----SGCFGLKLDRIGSMSGLGC- 161 (SEQ ID NO: 61)
tr|Q7T1M4|Q7T1M4_BOTJR     ----KGCFGLKLDRIGTMSGLGC- 221 (SEQ ID NO: 62)
tr|Q402A2|Q402A2_PETMA     --------CFGVKLDRIGSMSGLGC- 116 (SEQ ID NO: 63)
tr|Q402A3|Q402A3_LAMJA     --------CFGVKLDRIGSMSGLGC- 148 (SEQ ID NO: 64)
tr|Q402A1|Q402A1_9PETR     --------CFGVKLDRIGSMSGLGC- 133 (SEQ ID NO: 65)
sp|P21805|ANFC_CHICK       ------RSCFGVKLDRIGSMSGLGC- 22  (SEQ ID NO: 66)
tr|A9CDT6|A9CDT6_CHICK     ------RSCFGVKLDRIGSMSGLGC- 130 (SEQ ID NO: 67)
sp|P20968|ANFC_RANCA       ------RGCFGVKLDRIGAFSGLGC- 129 (SEQ ID NO: 68)
sp|P55208|ANFC_TRISC       ---RGCFGVKLDRIGAMSGLGC- 136 (SEQ ID NO: 69)
sp|P23259|ANFC_SCYCA       ---RGCFGVKLDRIGAMSGLGC- 115 (SEQ ID NO: 70)
sp|P41313|ANFC_SQUAC       ---RSCFGLKLDRIGAMSGLGC- 135 (SEQ ID NO: 71)
tr|Q2MH72|Q2MH72_9CHON     ----RGCFGVKLDRIGAMSGLGC- 131 (SEQ ID NO: 72)
tr|Q2MH73|Q2MH73_9CHON     ----RGCFGVKLDRIGAMSGLGC- 131 (SEQ ID NO: 73)
tr|Q2MH71|Q2MH71_9CHON     ----RGCFGVKLDRIGAMSGLGC- 131 (SEQ ID NO: 74)
tr|Q2MH74|Q2MH74_DASAK     ---RGCFGVKLDRIGAMSGLGC- 131 (SEQ ID NO: 75)
tr|Q2PF87|Q2PF87_CALMI     ---RGCFGVKLDRIGAMSGLGC- 139 (SEQ ID NO: 76)
sp|Q80018|ANFC3_ORYLA      ---RSCFGVRLERIGSFSGLGC- 112 (SEQ ID NO: 77)
tr|Q4ADV1|Q4ADV1_ORYLA     ---RSCFGVRLERIGSFSGLGC- 112 (SEQ ID NO: 78)
sp|Q805D4|ANFC3_TAKRU      ---RSCFGVRLARIGSFSGLGC- 158 (SEQ ID NO: 79)
tr|C0H7B0|C0H7B0_SALSA     ---RSCFGVRLERIGSFSGLGC- 128 (SEQ ID NO: 80)
tr|C1BWD1|C1BWD1_ESOLU     ---RSCFGVRLERIGSFSGLGC- 126 (SEQ ID NO: 81)
tr|D2KXA3|D2KXA3_ANGJA     ---RSCFGVRLERIGSFSGLGC- 128 (SEQ ID NO: 82)
tr|B3DJJ2|B3DJJ2_DANRE     ------RSCFGVRLERIGSFSGLGC- 128 (SEQ ID NO: 83)
tr|Q1XGY8|Q1XGY8_9ACTI     ---RSCFGVRLDRIGSMSGLGC- 130 (SEQ ID NO: 84)
sp|Q8AXR2|ANFC2_ONCMY      ---RGCFGLKLDRIGSMSGLGC- 131 (SEQ ID NO: 85)
sp|Q8AXR3|ANFC1_ONCMY      ---RGCFGLKLDRIGSMSGLGC- 131 (SEQ ID NO: 86)
tr|C1BKS8|C1BKS8_OSMMO     ---RGCFGLKLDRIGSMSGLGC- 132 (SEQ ID NO: 87)
tr|Q805E7|Q805E7_OREMO     ---RGCFGLKLDRIGSMSGLGC- 131 (SEQ ID NO: 88)
tr|C3KH23|C3KH23_ANOFI     ---RGCFGLKLDRIGSMSGLGC- 131 (SEQ ID NO: 89)
sp|Q8AYR6|ANFC1_ORYLA      ---RGCFGLKLDRIGSMSGLGC- 131 (SEQ ID NO: 90)
sp|Q805D6|ANFC1_TAKRU      ---RGCFGLKLDRIGSMSGLGC- 126 (SEQ ID NO: 91)
sp|P18145|ANFC_ANGJA       ---RGCFGLKLDRIGSLSGLGC- 131 (SEQ ID NO: 92)
tr|Q1XGY9|Q1XGY9_9ACTI     ----KGCFGLKLDRIGSISGLGC- 140 (SEQ ID NO: 93)
tr|A9CDT5|A9CDT5_CHICK     ---RGCFGLKMDRIGAFSGLGC- 123 (SEQ ID NO: 94)
                              *** : **.: **:**

CONSENSUS SEQUENCE            CFGXXXXRIXXXSGXGC           (SEQ ID NO: 95)
```

Schematic Structure of Natriuretic Peptide

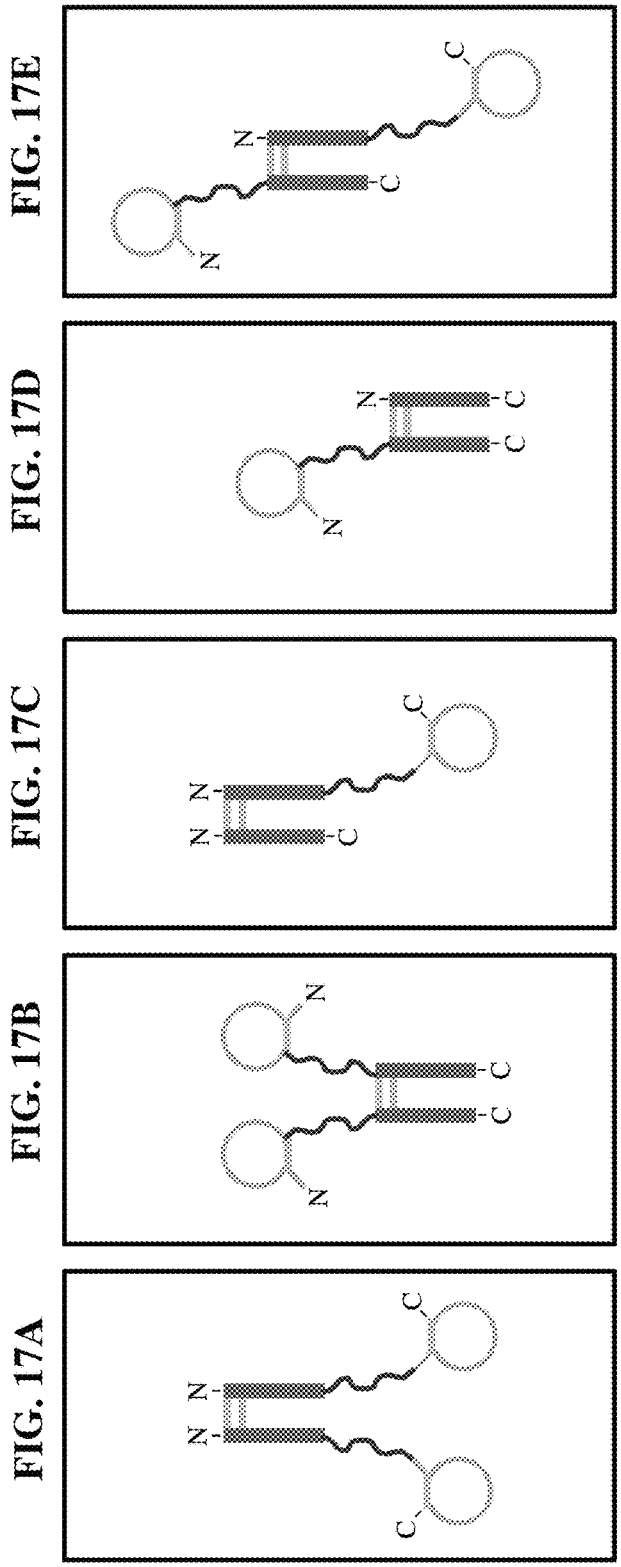

FIG. 18A

NC2st Protein Sequence (With Signal Sequence)

Sequence:

```
         10         20         30         40         50         60
MGVHECPAWL WLLLSLLSLW PGAYAASWSH PQFEQSGGGG GENLYFQGGD KTHTCPPCPA 70         80         90        100        110        120
PELLGGPSVF LFPPKPKDTL MISRTPEVTC VVVDVSHEDP EVKFNWYVDG VEVHNAKTKP 130        140        150        160        170        180
REEQYNSTYR VVSVLTVLHQ DWLNGKEYKC KVSNKALPAP IEKTISKAKG QPREPQVYTL 190        200        210        220        230        240
PPSREEMTKN QVSLTCLVKG FYPSDIAVEW ESNGQPENNY KTTPPVLDSD GSFFLYSKLT 250        260        270        280        290        300
VDKSRWQQGN VFSCSVMHEA LHNHYTQKSL SLSPGKGGGG SGGGGSGGGG SGGGGSGGGG

310
LKMDRISSSS SGLC
```

(SEQ ID NO: 501)

Number of amino acids: 314
Molecular weight of monomer: 34053.5

1-25 = Signal peptide
26-27 = Linker
28-35 = Strep-tag II
36-41 = Linker
42-47 = Tobacco etch virus protease cleavage sequence
48-49 = Linker
50-276 = Fc domain of human IgG1
277-292 = Glycine-rich linker
293-314 = C-type natriuretic peptide

FIG. 18B

NC2st Protein Sequence (Without Signal Sequence)

NC2st (w/o sig. seq.)  ASWSHPQFEQSGGGGENLYFQGGDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK*GGGGSGGGGSGGGGSGGIKSKCFGIKKLDRIIGSMSGLGC*

(SEQ ID NO: 502)

FIG. 18C

NC2st DNA Sequence

ATGGGGCGTGCACGAGTGTCCTGCCTGGCTGCTGCTGAGCCTGCTGTCTCTGTGGCCTGGCCTACGCCGCCTCTTGGAGC
CACCCCAGTTTGAGCAGTCTGGCGGCGGAGGAGGCGAGAACCTGTACTTTCAGGGCGGCGACAAGACCCACACCTGTCCCCCTTGT
CCTGCCCCTGAGCTGCTGGGCGGACCCAGCGTGTTCCTGTTCCCCAAAGCCCAAGGACACCCTGATGATCAGCCGGACCCCCGAA
GTGACCTGCGTGGTGGTGGACGTGTCCCACGAGGACCCTGAAGTGAAGTTCAATTGGTACGTGGACGGCGTGGAGGTGCACAACGCC
AAGACCAAGCCCCGGGAGGAACAGTACAACAGCACCTACCGTGTGCTGTCCGTGCTGACCGTGCTGCACCAGGACTGGCTGAACGGC
AAAGAGTACAAGTGCAAGGTCTCCAACAAGGCCCTGCCCGCCCCCATCGAGAAAACCATCAGCAAGGCCAAGGGCCAGCCCAGAGAA
CCCCAGGTGTACACCCTGCCCCCCAGCCGGGAGGAAATGACCAAGAACCAGGTGTCCCTGACCTGCCTGGTGAAGGGCTTCTACCCC
AGCGATATCGCCGTGGAGTGGGAGAGCAATGGGCAGCCTGAGAACAACTACAAGACCACCCCTGTGCTGGACAGCGACGGAAGC
TTCTTCCTGTACTCCAAACTGACCGTGGACAAGAGCCGGTGGCAGCAGGGCAACGTGTTCAGCTGCAGCGTGATGCACGAGGCCCTG
CACAACCACTACACCCAGAAGTCCCTGAGCCTGTCTCCGGGCAAGGGTGGACCGGGATCGGCGACCATGAGCGCAGCATGGAGGGCGGA
AGCGGCGGACTGAGCAACTGAGCAAGGGCGAAGGGCCCTGGGCTGCTGA (SEQ ID NO: 801)

FIG. 19A
NC2B Protein Sequences

NC2B (w/sig. seq.)  MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGGSGGGGSGGGGSGGGGSGLSKCFGLKLDRIGSMSGLSC
(SEQ ID NO: 503)

NC2B (w/o sig. seq.)  DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGGSGGGGSGGGGSGGGGSGLSKCFGLKLDRIGSMSGLSC (SEQ ID NO: 504)

D10-NC2 (w/sig. seq.)  MGVHECPAWLWLLLSLLSLWPGAYADDDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSGGGGSGGGGSGLSKCFGLKLDRI
GSMSGLSC (SEQ ID NO: 607)

D10-NC2 (w/o sig. seq.)  DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSGGGGSGGGGSGLSKCFGLKLDRIGSMSGLSC (SEQ ID NO: 608)

FIG. 19B
NC2B DNA Sequence

```
ATGGGCCTGCACGAGTGTCCTGCTGCCTGGCTGTGTGGCCTGCTGCTGAGCCTGCTGTCTCTGTGCCTGGCGCCTACGCCGACAAGACCCAC
ACCTGTCCCCCTTGTCCTGCCCCTGAGCTGCTGGGCGGACCCAGCGTGTTCCCTGTTCCCCCCAAAGCCAAGGACACCCTGATGATC
AGCCGGGACCCCGAAGTGACCTGCGTGGTGGTGGACGTGTCCCACGAGGACCCTGAAGTGAAGTTCAATTGGTACGTGGACGGCGTG
GAGGTGCACAATGCCAAGACCAAGCCACGGGAGGAACAGTACAACAGCACCTACCGGGTGGTGTCCGTGCTGACCGTGCTGCACCAG
GACTGGCTGAACGGCAAGGAGTACAAGTGCAAGGTCTCCAACAAGGCCCTGCCTGCCCCCATCGAGAAAACCATCAGCAAGGCCAAG
GGCCAGCCCAGAGAACCCCAGGTGTACACCCTGCCCCCCAGCCGGGAGGAGATGACCAAGAACCAGGTGTCCCTGACCTGCCTGGTG
AAGGGCTTCTACCCCAGCGATATCGCCGTGGAGTGGGAGAGCAATGGGCAGCCGGAGAACAACTACAAGACCACCCCCCTGTGCTG
GACAGCGACGGCAGCTTCTTCCTGTACTCCAAACTGACCGTGGACAAGAGCCGGTGGCAGCAGGGCAACGTGTTCAGCTGCAGCGTG
ATGCACGAGGCCCTGCACAACCACTACACCCAGAAGTCCCTGTCTCTGCCAAGGGCGGAGGCGGAAGTGGAGGCGGAGGA
AGCGGGGAGGCGGAAGCGGGACTGAGCAGCAAGGGCTGCTTCGGCCTGAAGCTGGACCGGATCGGCATGAGCGGCCTGGGCTGC
TGA (SEQ ID NO: 802)
```

FIG. 20A

NC2B-22, NC2B-28, and NC2B-34 Sequences

NC2B-22
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGGGSGGGGSK*GCFGLKFDRICSMS
GHGC (SEQ ID NO: 505)

NC2B-22
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSGGGGSGGGGSK*GCFGLKFDRICSMSGHGC (SEQ ID NO: 506)

NC2B-28
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGGGSGGGGSK*GCFGLKFDRICSMS
GHGC (SEQ ID NO: 507)

NC2B-28
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSGGGGSGGGGSK*GCFGLKFDRICSMSGHGC (SEQ ID NO: 508)

NC2B-34
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGGGSGGGGSK*GCFGLKFDRICSMS
GHGC (SEQ ID NO: 509)

NC2B-34
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSGGGGSGGGGSK*GCFGLKFDRICSMSGHGC (SEQ ID
NO: 510)

FIG. 20B
NC2B-22 DNA Sequence

```
ATGGGCGTGCACGAGTGTCCTGCTGCTGTGGCTGCTGTGCTCTGTGGCCTGAGCCTGTCTGTGGCCTGGCGCCTACGCCGACAAGACCCAC
ACCTGTCCCCCTTGTCCTGCCCCTGAAGTGACCTGCGTGGTGGTGCTGGGCGACCCCAGCCGTGTTCCTGTTCCCCCAAAGCCAAGGACACCCTGATGATC
AGCCGGACCCCCGAAGTGACCTGCGTGGTGGTGGACGTGTCCCACGAGGACCCTGAAGTGAAGTTCAATTGGTACGTGGACGGCGTG
GAGGTGCACAACGCCAAGACAAGCCCGGAGGAACAGTACAACAGCACCTACCGGGTGGTGTCCGTGCTGACCGTGCTGCACCAG
GACTGGCTGAACGGCAAAGAGTACAAGTGCAAGGTCTCCAACAAGGCCCTGCCCGCCCCCATCGAGAAAACCATCAGCAAGGCCAAG
GGCCAGCCCAGAGAACCCCAGGTGTACACCCTGCCCCCCAGCCGGGAGGAAATGACCAAGAACCAGGTGTCCCTGACCTGCCTGGTG
AAGGGCTTCTACCCCAGCGATATCGCCGTGGAGTGGGAGAGCAACGGCCAGCCTGAGAACAACTACAAGACCACCCCCCTGTGCTG
GACAGCGACGGCAGCTTCTTCCTGTACTCCAAACTGACCGTGGACAAGAGCCGGTGGCAGCAGGGCAACGTGTTCAGCTGCAGCGTG
ATGCACGAGGCCCTGCACAACCACTACACCCAGAAGTCCCTGCCGGCGGACTGAGCCCGCCCGGCTGCTTCGGCCTGAAGCTGGACCCGGAGCTGGGCCTGAAGGGCTGCTTCGGCCTGAAGCTGGACCCGGATCGGCAGC
AGCGGGGCGGAGGCGGAAGCGGAGGATCTGGCGGCGGAGGCCTGA (SEQ ID NO: 803)
```

FIG. 20C

NC2B-28 DNA Sequence

```
ATGGGCCGTGCACGAGTGTCCTGCCTGGCTGTGGCTGCTGAGCCTGCTGTCTCTGTGGCCTGGCGCCTGGCCTACGCCGACAAGACCCAC
ACCTGTCCCCCTTGTCCTGCCCCTGAGCTGCTGGGCGACCAGCGTGTTCCCCAAAGCCAAGGACACCCTGATGATC
AGCCGGACCCCCGAAGTGACCTGCGTGGTGGTGGATGTGTCCCACGAGGACCCTGAAGTGAAGTTCAATTGGTACGTGGACGGCGTG
GAGGTGCACAATGCCAAGACCAAGCCCCGGGAGGAACAGTACAACAGCACCTACCGTGGTGTCCGTGCTGACCGTGCTGCACCAG
GACTGGCTGAACGGCAAAGAGTACAAGTGCAAGGTCTCCAACAAGGCCCTGCCCGCCCCCATCGAGAAAACCATCAGCAAGGCCAAG
GGCCAGCCCAGAGAACCCCAGGTGTACACCCTGCCCCCTAGCCGGGAGGAAATGACCAAGAACCAGGTGTCCCTGACCTGCCTGGTG
AAGGGCTTCTACCCCAGCGATATCGCCGTGGAGTGGGAGAGCAACGGCCAGCCTGAGAACTACAAGACCACCCCTGTGCTG
GACAGCGACGGCAGCTTCTTCCTGTACTCCAAACTGACCGTGGACAAGAGCCGGTGGCAGCAGGGCAACGTGTTCAGCTGCAGCGTG
ATGCACGAGGCCCTGCACAACCACTACACCCAGAAGTCCCTGAGCCTGTCTCTGGGCAAGGGCGAGGGCGAAGTGGAGGCGGAGGA
AGCGGGGGAGGCGGAGGCGGAAGCCGGAGGATCGGCGAAGGCGGACTGGCCGAAGTGGCGGCCGACTGAGCAGCAAGGGCTGCTTCGGCCTGAAG
CTGGACCGGATCGGCAGCATGAGCGGCCTGGGCCTGCTGA (SEQ ID NO: 804)
```

FIG. 20D
NC2B-34 DNA Sequence

ATGGGCGTGCACGAGTGTCCTGCCTGGCTGTGCCTGCTGCTGTGAGCCTGCTGTCTCTGTGGCCTGGCGCCTACGCCGACAAGACCCAC
ACCTGTCCCCCTTGTCCTGCCCCTGAGCTGCTGGGCGACCAGCGTGTTCCTGTTCCCCCAAAGCCAAGGACACCCTGATGATC
AGCCGGACCCCCGAAGTGACCTGCGTGGTGGACGTGTCCCACGAGGACCCTGAAGTGAAGTTCAATTGGTACGTGGACGGCGTG
GAGGTGCACAATGCCAAGACCAAGCCCCGGGAGGAACAGTACAACAGCACCTACCGGGTGGTGTCCGTGCTGACCGTGCTGCACCAG
GACTGGCTGAACGGCAAAGAGTACAAGTGCAAGGTCTCCAACAAGGCCCTGCCTGCCCCCATCGAGAAAACCATCAGCAAGGCCAAG
GGCCAGCCCAGAGAACCCCAGGTGTACACCCTGCCCCCCAGCCGGGAGGAAATGACCAAGAACCAGGTGTCCCTGACCTGCCTGGTG
AAGGGCTTCTACCCCAGCGATATCGCCGTGGAGTGGGAGAGCAACGGCCAGCCTGAGAACAACTACAAGACCACCCCCTGTGCTG
GACAGCGACGGCAGCTTCTTCCTGTACTCCAAACTGACCGTGGACAAGTCCCGGTGGCAGCAGGGCAACGTGTTCAGCTGCAGCGTG
ATGCACGAGGCCCTGCACAACCACTACACCCAGAAGTCCCTGAGCCTGTCTCCTGGCAAGGGCGGCGAAGTGGAGGCGGAGGA
AGCGGCGGAGGCGGAAGCGGAGGCGGAGGATCTGGCGGAGGCGGCAGCGGCGGCGGAGGCGGAGGGGGAGGACTGAGCAAG
GGCTGCTTCGGCCTGAAGCCTGAAGCGCTGGACCGGGATCGGCCAGCATGAGCGGCCCTGGCTGCTGA (SEQ ID NO: 805)

FIG. 21

NC2 Variants

NC2-KGANKK
(w/sig. seq.)

MGVHECFAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQK*KSLSLSPGKGGGGSGGGGSKGANKKGLSKCFTGLKLDRIGSMSGLGC*
(SEQ ID NO: 511)

NC2-KGANKK
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
*KSLSLSPGKGGGGSGGGGSKGANKKGLSKCFTGLKLDRIGSMSGLGC* (SEQ ID NO: 512)

NC2-KGANQK
(w/sig. seq.)

MGVHECFAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQK*KSLSLSPGKGGGGSGGGGSKGANQKGLSKCFTGLKLDRIGSMSGLGC*
(SEQ ID NO: 513)

NC2-KGANQK
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
*KSLSLSPGKGGGGSGGGGSKGANQKGLSKCFTGLKLDRIGSMSGLGC* (SEQ ID NO: 514)

FIG. 22

NC2 Variants

NC2-CNP53mut2 (w/sig. seq.)

MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLQVDTQSQAAWAQLLQEHPNAQQYKGANKKGLSKGC
FCLKKLDRIGSMSGLGC* (SEQ ID NO: 515)

NC2-CNP53mut2 (w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLQVDTQSQAAWAQLLQEHPNAQQYKGANKKGLSKGCFCLKKLDRIGSMSGLGC* (SEQ ID
NO: 516)

FIG. 23

Fc-CNP53 Constructs

Fc-CNP53-A
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGDIRVDTKSRAAWARLLQEHPNARKYKGANKKGLSKGC
FGLKLDRIGSASSLGC (SEQ ID NO: 517)

Fc-CNP53-A
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGDIRVDTKSRAAWARLLQEHPNARKYKGANKKGLSKGCFGLKLDRIGSASSLGC (SEQ ID
NO: 518)

Fc-CNP53-AAA
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGDIRVDTKSRAAWARLLQEHPNARKYKGANAAGLSKGC
FGLKLDRIGSASSLGC (SEQ ID NO: 519)

Fc-CNP53-AAA
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGDIRVDTKSRAAWARLLQEHPNARKYKGANAAGLSKGCFGLKLDRIGSASSLGC (SEQ ID
NO: 520)

FIG. 24

NP Multiple Sequence Alignment and CDNP Constructs

```
Human ANP                         SLRRSSCFGGRMDRIGAQSGLGCNSFRY                        (SEQ ID NO: 1)
Rat ANP                           SLRRSSCFGGRIDRIGAQSGLGCNSFRY                        (SEQ ID NO: 96)
Urodilatin              TAPRSLRRSSCFGGRMDRIGAQSGLGCNSFRY                              (SEQ ID NO: 2)
Human BNP                         SPKMVQGSGCFGRKMDRISSSSGLGCKVLRRH                    (SEQ ID NO: 3)
Rat BNP      SQDSAFRIQERLRNSKMAHSSCFGQKIDRIGAVSRLGCDGLRLF                             (SEQ ID NO: 97)
Pig BNP                           SPKTMRDSGCFGRRLDRIGSLSGLGCNVLRRY                    (SEQ ID NO: 98)
DNP                                EVKYDPCFGHKIDRINHVSNLGCPSLRDPRPNAPSTSA             (SEQ ID NO: 5)
TNP-C                             SDSKIGNGCFGFPLDRIGSVSGLGCNRIMQNPPKKFSGE             (SEQ ID NO: 99)
CDNP                              GLSKGCFGLKLDRIGSMSGLGCPSLRDPRPNAPSTSA              (SEQ ID NO: 100)
                                       ***  : ***     *,***   *:.

CDNP-N1 (C7)                      GLSKGCFGLKLDRIGSMSGLGCNSLRDPRPNAPSTSA              (SEQ ID NO: 101)
CDNP-G1 (C8)                      GLSKGCFGLKLDRIGSMSGLGCGSLRDPRPNAPSTSA              (SEQ ID NO: 102)
CDNP-H1 (C9)                      GLSKGCFGLKLDRIGSMSGLGCHSLRDPRPNAPSTSA              (SEQ ID NO: 103)
CDNP-K1                           GLSKGCFGLKLDRIGSMSGLGCKSLRDPRPNAPSTSA              (SEQ ID NO: 104)
CDNP-Z1 (Z=hydroxyproline)        GLSKGCFGLKLDRIGSMSGLGCZSLRDPRPNAPSTSA              (SEQ ID NO: 105)
CDNP-S3                           GLSKGCFGLKLDRIGSMSGLGCPSSRDPRPNAPSTSA              (SEQ ID NO: 106)
CDNP-A4                           GLSKGCFGLKLDRIGSMSGLGCPSLADPRPNAPSTSA              (SEQ ID NO: 107)
CDNP-A5                           GLSKGCFGLKLDRIGSMSGLGCPSLRAPRPNAPSTSA              (SEQ ID NO: 108)
CDNP-S3A4 (C12)                   GLSKGCFGLKLDRIGSMSGLGCPSSADPRPNAPSTSA              (SEQ ID NO: 109)
CDNP-A4A5                         GLSKGCFGLKLDRIGSMSGLGCPSLAAPRPNAPSTSA              (SEQ ID NO: 110)
CDNP-S3A5 (C11)                   GLSKGCFGLKLDRIGSMSGLGCPSSRAPRPNAPSTSA              (SEQ ID NO: 111)
CDNP-(A17)S3A5                    GLSKGCFGLKLDRIGSASGLGCPSSRAPRPNAPSTSA              (SEQ ID NO: 112)
CDNP-S3A4A5 (C10)                 GLSKGCFGLKLDRIGSMSGLGCPSSAAPRPNAPSTSA              (SEQ ID NO: 113)
CDNP-(A17)S3A4A5                  GLSKGCFGLKLDRIGSASGLGCPSSAAPRPNAPSTSA              (SEQ ID NO: 114)
CDNP-S3A4A5R6 (C13)               GLSKGCFGLKLDRIGSMSGLGCPSSAARRPNAPSTSA              (SEQ ID NO: 115)
CDNP-S3A4A5S7 (C14)               GLSKGCFGLKLDRIGSMSGLGCPSSAAPSPNAPSTSA              (SEQ ID NO: 116)

DNP TAIL                                               PSLRDPRPNAPSTSA               (SEQ ID NO: 117)
CONSENSUS SEQUENCE FOR DNP C-TERMINAL TAIL             XSXXXXXPNAPSTSA                (SEQ ID NO: 118)
```

FIG. 25A

Exemplary Constructs Having N-terminal NP fused to C-terminal Fc Domain

CNP-16AAlinker-Fc-His₁₀ (NC1)
GLSKGCFGLKLDRIGSMSGLGCGGGGSGGGGSGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGENLYFQGSHHHHHHHHHH (SEQ ID NO: 521)

CNP-6AAlinker-Fc-His₁₀ (NC3)
GLSKGCFGLKLDRIGSMSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGENLYFQGSHHHHHHHHHH (SEQ ID NO: 522)

CNP-6AAlinker-Fc
GLSKGCFGLKLDRIGSMSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 523)

CDNP-Fc
GLSKGCFGLKLDRIGSMSGLGCPSSRDPPRPNESTEGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 524)

CDNP-A17saa-Fc
GLSKGCFGLKLDRIGSASGLGCPSSRAPPRPNASSEGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 525)

CDNP-A17sra-Fc
GLSKGCFGLKLDRIGSASGLGCPSSRAPPRPNESTEGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 526)

FIG. 25B
NC1 DNA Sequence

ATGGGCGTGCACGAGTGTCTCCTGCCTGCTGTGGCTGTGCTGCTGTCTCTGTGGCCTGCTGCCGCCTGAGCAAG
GGCTGCTTCGGCCCTGAAGCTGGACCGGATCGGCAGCATGTCTGGCCTGGGCTGTGTGGAGGCGGAGGATCTGGCGGCGGGAGGAAGTGGC
GGAGGCGGCAGCGGCGATAAGACCACACCTGTCCCCCCTTGTCCTGCCCCTGAAGTGACCTGGGCGGACCGGCAGCGCGCTGTTCCCC
CCAAAGCCCAAGGACACCCTGATGATCAGCCGGACCCCTGAAGTGACCTGCGTGGTGGACGTGTCCCACGAGGACCCTGAAGTG
AAGTTCAATTGGTACGTGGACGGCGTGGAGGTGCACAATGCCAAGACAAGCCCCGGGAGGAACAGTACAACAGCACCTACCGGGTG
GTGTCCGTGCTGACCGTGCTGCACCAGGACTGGCTGAACGGCAAAGAGTACAAGTGCAAGGTCTCCAACAAGGCCCTGCCTGCCCCC
ATCGAGAAAACCATCAGCAAGGCCAAGGGCCAGCCCCGAGAACCCCAGGTGTACACCCTGCCCCCAAGCCGGGAGGAAATGACCAAG
AACCAGGTGTCCCTGACCTGCCTGGTGAAGGGCTTCTACCCCAGCGATATCGCCGTGGAGTGGGAGAGCAACGGCCAGCCTGAGAAC
AACTACAAGACCACCCCCCCCTGTGCTGGACAGCGACGGCAGCTTCTTCCTGTACTCCAAACTGACCGTGGACAAGAGCCGGTGGCAG
CAGGGCAACGTGTTCAGCTGCAGCGTGATGCACGAGGCCCTGCACAACCACTACACCCAGAAGTCCCTGAGCCTGTCTCCTGGCAAG
GGCGGCGAGAACCTGTACTTTCAGGGCAGCCACCACCATCACCATCACCACCATCATCACTGA (SEQ ID NO: 806)

FIG. 26

Human CNP22 and Point Mutations at Position 17

| | | |
|---|---|---|
| CNP22 | GLSKGCFGLKLDRIGSMSGLGC | (SEQ ID NO: 4) |
| CNP-F17 (C15) | GLSKGCFGLKLDRIGSFSGLGC | (SEQ ID NO: 119) |
| CNP-L17 (C16) | GLSKGCFGLKLDRIGSLSGLGC | (SEQ ID NO: 120) |
| CNP-I17 (C17) | GLSKGCFGLKLDRIGSISGLGC | (SEQ ID NO: 121) |
| CNP-T17 (C18) | GLSKGCFGLKLDRIGSTSGLGC | (SEQ ID NO: 122) |
| CNP-V17 (C19) | GLSKGCFGLKLDRIGSVSGLGC | (SEQ ID NO: 123) |
| CNP-A17 (C1) | GLSKGCFGLKLDRIGSASGLGC | (SEQ ID NO: 124) |
| CNP-S17 | GLSKGCFGLKLDRIGSSSGLGC | (SEQ ID NO: 125) |
| CNP-E17 | GLSKGCFGLKLDRIGSESGLGC | (SEQ ID NO: 156) |
| CNP-R17 | GLSKGCFGLKLDRIGSRSGLGC | (SEQ ID NO: 157) |
| CNP-Y17 | GLSKGCFGLKLDRIGSYSGLGC | (SEQ ID NO: 158) |
| CONSENSUS: | GLSKGCFGLKLDRIGSXSGLGC | (SEQ ID NO: 126) |

FIG. 27

CNP Variants

```
CNP22                        GLSKGCFGLKLDRIGSMSGLGC              (SEQ ID NO: 4)
CNP37             QEHPNARKYKGANKKGLSKGCFGLKLDRIGSMSGLGC           (SEQ ID NO: 127)
E6PGCNP37   EEEEEEPGQEHPNARKYKGANKKGLSKGCFGLKLDRIGSMSGLGC         (SEQ ID NO: 128)
C1(E6)      EEEEEESGGGGSGGGGSGGGGLSKGCFGLKLDRIGSMSGLGC            (SEQ ID NO: 129)
C2(E6)      EEEEEEASTSPANPQPAASSPGLSKGCFGLKLDRIGSMSGLGC           (SEQ ID NO: 130)
C3(E6)      EEEEEEPSSAAPQPNAPSTSAGLSKGCFGLKLDRIGSMSGLGC           (SEQ ID NO: 131)
C4(E6)      EEEEEESGGGGSGGGKGANKKGLSKGCFGLKLDRIGSMSGLGC           (SEQ ID NO: 132)
C5(E6)      EEEEEESGGGGSGGGQGANQQGLSKGCFGLKLDRIGSMSGLGC           (SEQ ID NO: 133)
C6(E6)      EEEEEESGGGGSGGGKGANQKGLSKGCFGLKLDRIGSMSGLGC           (SEQ ID NO: 134)
C7(E6)      EEEEEESGGGGSGGGQGANKQGLSKGCFGLKLDRIGSMSGLGC           (SEQ ID NO: 135)
C8(E6)      EEEEEESGGGGSGGGKGANQQGLSKGCFGLKLDRIGSMSGLGC           (SEQ ID NO: 136)
C9(E6)      EEEEEESGGGGSGGGQGANKKGLSKGCFGLKLDRIGSMSGLGC           (SEQ ID NO: 137)
C10(E6)     EEEEEESGGGGSGGGQGANQKGLSKGCFGLKLDRIGSMSGLGC           (SEQ ID NO: 138)
C11(E6)     EEEEEESGGGGSGGGKGANKQGLSKGCFGLKLDRIGSMSGLGC           (SEQ ID NO: 139)
D6CNP37     DDDDDDQEHPNARKYKGANKKGLSKGCFGLKLDRIGSMSGLGC           (SEQ ID NO: 140)
C1(D6)      DDDDDDSGGGGSGGGGSGGGGLSKGCFGLKLDRIGSMSGLGC            (SEQ ID NO: 141)
C2(D6)      DDDDDDASTSPANPQPAASSGGLSKGCFGLKLDRIGSMSGLGC           (SEQ ID NO: 142)
C3(D6)      DDDDDDGSSAAPQPNAPSTSAGLSKGCFGLKLDRIGSMSGLGC           (SEQ ID NO: 143)
C4(D6)      DDDDDDSGGGGSGGGKGANKKGLSKGCFGLKLDRIGSMSGLGC           (SEQ ID NO: 144)
C5(D6)      DDDDDDSGGGGSGGGQGANQQGLSKGCFGLKLDRIGSMSGLGC           (SEQ ID NO: 145)
C6(D6)      DDDDDDSGGGGSGGGKGANQKGLSKGCFGLKLDRIGSMSGLGC           (SEQ ID NO: 146)
D6-14AAlinker-CNP  DDDDDDGGGGSGGGGSGGGGLSKGCFGLKLDRIGSMSGLGC   (SEQ ID NO: 147)
CNP-14AAlinker-D6  GLSKGCFGLKLDRIGSMSGLGCGGGGSGGGGSGGGGDDDDDD
                                                                 (SEQ ID NO: 148)
CNP-Nterm1  GSSAAPRPNAPSTSAGLSKGCFGLKLDRIGSMSGLGC                 (SEQ ID NO: 149)
CNP-Nterm2  ASTSPANPRPAASSGGLSKGCFGLKLDRIGSMSGLGC                 (SEQ ID NO: 150)
```

FIG. 28A
Additional CNP Variants

| Sequence | SEQ ID NO |
|---|---|
| GDLRVDTKSRAAWARLLQEHPNARKYKGANKKGLSKGCFGLKLDRIGSMSGLGC | (SEQ ID NO:1001) |
| PDLRVDTKSRAAWARLLQEHPNARKYKGANKKGLSKGCFGLKLDRIGSMSGLGC | (SEQ ID NO:1002) |
| MDLRVDTKSRAAWARLLQEHPNARKYKGANKKGLSKGCFGLKLDRIGSMSGLGC | (SEQ ID NO:1003) |
| DLRVDTKSRAAWARLLQEHPNARKYKGANKKGLSKGCFGLKLDRIGSNSGLGC | (SEQ ID NO:1004) |
| LRVDTKSRAAWARLLQEHPNARKYKGANKKGLSKGCFGLKLDRIGSMSGLGC | (SEQ ID NO:1005) |
| RVDTKSRAAWARLLQEHPNARKYKGANKKGLSKGCFGLKLDRIGSMSGLGC | (SEQ ID NO:1006) |
| VDTKSRAAWARLLQEHPNARKYKGANKKGLSKGCFGLKLDRIGSMSGLGC | (SEQ ID NO:1007) |
| DTKSRAAWARLLQEHPNARKYKGANKKGLSKGCFGLKLDRIGSMSGLGC | (SEQ ID NO:1008) |
| TKSRAAWARLLQEHPNARKYKGANKKGLSKGCFGLKLDRIGSMSGLGC | (SEQ ID NO:1009) |
| KSRAAWARLLQEHPNARKYKGANKKGLSKGCFGLKLDRIGSMSGLGC | (SEQ ID NO:1010) |
| SRAAWARLLQEHPNARKYKGANKKGLSKGCFGLKLDRIGSMSGLGC | (SEQ ID NO:1011) |
| RAAWARLLQEHPNARKYKGANKKGLSKGCFGLKLDRIGSMSGLGC | (SEQ ID NO:1012) |
| AAWARLLQEHPNARKYKGANKKGLSKGCFGLKLDRIGSMSGLGC | (SEQ ID NO:1013) |
| AWARLLQEHPNARKYKGANKKGLSKGCFGLKLDRIGSMSGLGC | (SEQ ID NO:1014) |
| WARLLQEHPNARKYKGANKKGLSKGCFGLKLDRIGSMSGLGC | (SEQ ID NO:1015) |
| ARLLQEHPNARKYKGANKKGLSKGCFGLKLDRIGSMSGLGC | (SEQ ID NO:1016) |
| RLLQEHPNARKYKGANKKGLSKGCFGLKLDRIGSMSGLGC | (SEQ ID NO:1017) |
| LLQEHPNARKYKGANKKGLSKGCFGLKLDRIGSMSGLGC | (SEQ ID NO:1018) |
| LQEHPNARKYKGANKKGLSKGCFGLKLDRIGSMSGLGC | (SEQ ID NO:1019) |
| QEHPNARKYKGANKKGLSKGCFGLKLDRIGSMSGLGC | (SEQ ID NO:1020) |
| EHPNARKYKGANKKGLSKGCFGLKLDRIGSMSGLGC | (SEQ ID NO:1021) |
| HPNARKYKGANKKGLSKGCFGLKLDRIGSMSGLGC | (SEQ ID NO:1022) |
| PNARKYKGANKKGLSKGCFGLKLDRIGSMSGLGC | (SEQ ID NO:1023) |
| NARKYKGANKKGLSKGCFGLKLDRIGSMSGLGC | (SEQ ID NO:1024) |
| ARKYKGANKKGLSKGCFGLKLDRIGSMSGLGC | (SEQ ID NO:1025) |
| RKYKGANKKGLSKGCFGLKLDRIGSMSGLGC | (SEQ ID NO:1026) |
| KYKGANKKGLSKGCFGLKLDRIGSMSGLGC | (SEQ ID NO:1027) |
| YKGANKKGLSKGCFGLKLDRIGSMSGLGC | (SEQ ID NO:1028) |
| KGANKKGLSKGCFGLKLDRIGSMSGLGC | (SEQ ID NO:1029) |
| GANKKGLSKGCFGLKLDRIGSMSGLGC | (SEQ ID NO:1030) |
| ANKKGLSKGCFGLKLDRIGSMSGLGC | (SEQ ID NO:1031) |
| NKKGLSKGCFGLKLDRIGSMSGLGC | |

FIG. 28B

```
                                    RKGLSKGCFGLKLDRIGSMSGLGC  (SEQ ID NO:1032)
                                     RGLSKGCFGLKLDRIGSMSGLGC  (SEQ ID NO:1033)
                                      LSKGCFGLKLDRIGSMSGLGC   (SEQ ID NO:1034)
                                       SKGCFGLKLDRIGSMSGLGC   (SEQ ID NO:1035)
                                        KGCFGLKLDRIGSMSGLGC   (SEQ ID NO:1036)
                                         GCFGLKLDRIGSMSGLGC   (SEQ ID NO:1037)
           QEHPNARKYKGANKKGLSKGCFGLKLDRIGSNSGLGC              (SEQ ID NO:1038)
          PQEHPNARKYKGANKKGLSKGCFGLKLDRIGSMSGLGC              (SEQ ID NO:1039)
          MQEHPNARKYKGANKKGLSKGCFGLKLDRIGSMSGLGC              (SEQ ID NO:1040)
          GQEHPNARKYKGANKKGLSKGCFGLKLDRIGSMSGLGC              (SEQ ID NO:1041)
          GQEHPNARKYKGANPKGLSKGCFGLKLDRIGSMSGLGC              (SEQ ID NO:1042)
          GQEHPNARKYKGANQKGLSKGCFGLKLDRIGSMSGLGC              (SEQ ID NO:1043)
          GQEHPNARKYKGANQQGLSKGCFGLKLDRIGSMSGLGC              (SEQ ID NO:1044)
          GQEHPNARKYKGANKPGLSKGCFGLKLDRIGSMSGLGC              (SEQ ID NO:1045)
          GQEHPNARKYKGANKKGLSKGCFGLKLDRIGSNSGLGC              (SEQ ID NO:1046)
          PGQEHPNARKYKGANKKGLSKGCFGLKLDRIGSMSGLGC             (SEQ ID NO:1047)
         MGQEHPNARKYKGANKKGLSKGCFGLKLDRIGSMSGLGC              (SEQ ID NO:1048)
                         GANRRGLSRGCFGLKLDRIGSNSGLGC          (SEQ ID NO:1049)
                         GANRRGLSRGCFGLKLDRIGSMSGLGC          (SEQ ID NO:1050)
                        PGANRRGLSRGCFGLKLDRIGSMSGLGC          (SEQ ID NO:1051)
                        MGANRRGLSRGCFGLKLDRIGSMSGLGC          (SEQ ID NO:1052)
             GHKSEVAHRFKGANKKGLSKGCFGLKLDRIGSMSGLGC           (SEQ ID NO:1053)
             GHKSEVAHRFKGANKKGLSKGCFGLKLDRIGSNSGLGC           (SEQ ID NO:1054)
            PGHKSEVAHRFKGANKKGLSKGCFGLKLDRIGSMSGLGC           (SEQ ID NO:1055)
           MGHKSEVAHRFKGANKKGLSKGCFGLKLDRIGSMSGLGC            (SEQ ID NO:1056)
                                 RGLSRGCFGLKLDRIGSMSGLGC     (SEQ ID NO:1057)
                                 ERGLSRGCFGLKLDRIGSMSGLGC    (SEQ ID NO:1058)
                              GANQQGLSKGCFGLKLDRIGSMSGLGC    (SEQ ID NO:1059)
                              GANRRGLSKGCFGLKLDRIGSMSGLGC    (SEQ ID NO:1060)
                              GANPRGLSKGCFGLKLDRIGSMSGLGC    (SEQ ID NO:1061)
                              GANSSGLSKGCFGLKLDRIGSMSGLGC    (SEQ ID NO:1062)
```

FIG. 28C

```
                    GANPRGLSRGCFGLKLDRIGSMSGLGC    (SEQ ID NO:1063)
                    GANRRGLSRGCFGLKLDRIGSMSGLGC    (SEQ ID NO:1064)
                    GANQQGLSRGCFGLKLDRIGSMSGLGC    (SEQ ID NO:1065)
                    GANSSGLSRGCFGLKLDRIGSMSGLGC    (SEQ ID NO:1066)
           AAWARLLQEHPNAGLSKGCFGLKLDRIGSMSGLGC    (SEQ ID NO:1067)
           AAWARLLQEHPNARGLSKGCFGLKLDRIGSMSGLGC    (SEQ ID NO:1068)
           DLRVDTKSRAAWARGLSKGCFGLKLDRIGSMSGLGC    (SEQ ID NO:1069)
         GQEHPNARKYKGANPKGLSKGCFGLKLDRIGSMSGLGC    (SEQ ID NO:1070)
         GQEHPNARKYKGANQKGLSKGCFGLKLDRIGSMSGLGC    (SEQ ID NO:1071)
                        GLSRGCFGLKLDRIGSMSGLGC    (SEQ ID NO:1072)
                        ERGLSKGCFGLKLDRIGSMSGLGC   (SEQ ID NO:1073)
                        RGLSKGCFGLKLDRIGSMSGLGC    (SEQ ID NO:1074)
                        GLSRGCFGLKLDRIGSMSGLGC     (SEQ ID NO:1075)
                        GLSKGCFGLKLDRIGSMSGLGC     (SEQ ID NO:1076)
                        GLSKGCXGLKLDRIGSMSGLGC     (SEQ ID NO:1077)
                        GLSKGCXGLKLDRIGSMSGLGC     (SEQ ID NO:1078)
                        RLSKGCFGLKLDRIGSMSGLGC     (SEQ ID NO:1079)
                        ELSKGCFGLKLDRIGSMSGLGC     (SEQ ID NO:1080)
                        GLSKRCFGLKLDRIGSMSGLGC     (SEQ ID NO:1081)
                        GLSKQCFGLKLDRIGSMSGLGC     (SEQ ID NO:1082)
                        GLSKSCFGLKLDRISSMSGLGC     (SEQ ID NO:1083)
                        GLSKGCFGLKLDRINSMSGLGC     (SEQ ID NO:1084)
                        GLSKGCFGLKLDRIRSMSGLGC     (SEQ ID NO:1085)
                        GLSKGCFGLKLDRIXSMSGLGC     (SEQ ID NO:1086)
                        GLSKGCFGLKLDRIGSMSSLGC     (SEQ ID NO:1087)
                        GLSKGCFGLKLDRIGSMSRLGC     (SEQ ID NO:1088)
                        GLSKGCFGLKLDRIGSMSNLGC     (SEQ ID NO:1089)
                        GLSKGCFGLKLDRIGSMSGLSC     (SEQ ID NO:1090)
                        GLSKGCFGLKLDRIGSMSGLTC     (SEQ ID NO:1091)
                        GLSKGCFGLKLDRIGSMSGLRC     (SEQ ID NO:1092)
                        GLSKGCXFGLKLDRIGSMSGLGC    (SEQ ID NO:1093)
```

(X: D-Phe)
(X: 3-amino-2-phenylpropionic acid)

(X: Cit)

(X: [CH$_2$NH]bond)

FIG. 28D

| | |
|---|---|
| GLSKGCXGLKLDRIGSMSGLGC | (SEQ ID NO:1094) |
| GLSKGCFXLKLDRIGSMSGLGC | (SEQ ID NO:1095) |
| GLSKGCXGLKLDRIGSMSGLGC | (SEQ ID NO:1096) |
| GQPREPQVYTLPPSGLSKGCFGLKLDRIGSMSGLGC | (SEQ ID NO:1097) |
| GERAFKAWAVARLSQGLSKGCFGLKLDRIGSMSGLGC | (SEQ ID NO:1098) |
| GQHKDDNPNLPRGANPRGLSKGCFGLKLDRIGSMSGLGC | (SEQ ID NO:1099) |
| GHHSHEQHPHGANQQGLSKGCFGLKLDRIGSMSGLGC | (SEQ ID NO:1100) |
| GAHHPHEHDTHGANQQGLSKGCFGLKLDRIGSMSGLGC | (SEQ ID NO:1101) |
| FGIPMDRIGRNPRGLSKGCFGLKLDRIGSMSGLGC | (SEQ ID NO:1102) |
| GKRTGQYKLGSKTGPGFKGLSKGCFGLKLDRIGSMSGLGCKVLRRH | (SEQ ID NO:1103) |
| SPKMVQGSGCFGLKLDRIGSMSGLGCKVLRRH | (SEQ ID NO:1104) |
| GQPREPQVYTGANQQGLSRGCFGLKLDRIGSMSGLGC | (SEQ ID NO:1105) |
| GVPQVSTSTGANQQGLSRGCFGLKLDRIGSMSGLGC | (SEQ ID NO:1106) |
| GQFSSSSQSTGANQQGLSRGCFGLKLDRIGSMSGLGC | (SEQ ID NO:1107) |
| GSTGQWHSESGANQQGLSRGCFGLKLDRIGSMSGLGC | (SEQ ID NO:1108) |
| GQTHSSGTQSGANQQGLSRGCFGLKLDRIGSMSGLGC | (SEQ ID NO:1109) |
| GSSSSSSSSGANQQGLSRGCFGLKLDRIGSMSGLGC | (SEQ ID NO:1110) |
| GLSKGCX$_1$FGX$_2$KLDRIGSMSGX$_3$GC | (SEQ ID NO:1111) |
| GLSKGCFGX$_1$KLDRIGSMSGX$_2$GC | (SEQ ID NO:1112) |
| GLSKGCFGX$_1$KX$_2$DRIGSMSGX$_3$GC | (SEQ ID NO:1113) |
| GLSKGCFGX$_1$KX$_2$DRIGSMSGLGC | (SEQ ID NO:1114) |
| GLSRGCYGLKLDRIGSMSGLGC | (SEQ ID NO:1115) |
| GLSRGCFVLKLDRIGSMSGLGC | (SEQ ID NO:1116) |
| GLSRGCFSLKLDRIGSMSGLGC | (SEQ ID NO:1117) |
| GLSRGCFTLKLDRIGSMSGLGC | (SEQ ID NO:1118) |
| GLSRGCFGTKLDRIGSMSGLGC | (SEQ ID NO:1119) |
| GLSRGCFGLKLDRIRSMSGLGC | (SEQ ID NO:1120) |
| GLSRGCFGLKLDRIXSMSGLGC | (SEQ ID NO:1121) |
| GLSRGCFGLKLDRIGSVSGLGC | (SEQ ID NO:1122) |
| GLSRGCFGLKLDRIGSMSGVGC | (SEQ ID NO:1123) |
| GLSRGCFGLKLDRIGSMSGXGC | (SEQ ID NO:1124) |

(X: N-Me-Phe)
(X: t-Bu-Gly)
(X: NHCH$_2$CH(Ph)CO)

(X$_1$: [CH$_2$NH] bond; X$_2$ and X$_3$: N-Me-Leu)
(X$_1$ and X$_2$: N-Me-Leu)
(X$_1$, X$_2$, and X$_3$: N-Me-Leu)
(X$_1$ and X$_2$: N-Me-Leu)

(X: Cit)

(X: t-Bu-Ala)

FIG. 28E

```
                                    ELSEGCFGLKLDRIGSMSGLGC  (SEQ ID NO:1125)
(X: pentanoic acid)                 XELSEGCFGLKLDRIGSMSGLGC (SEQ ID NO:1126)
(X: heptanoic acid)                 XELSEGCFGLKLDRIGSMSGLGC (SEQ ID NO:1127)
(X: pentanoic acid)                 XELSKGCFGLKLDRIGSMSGLGC (SEQ ID NO:1128)
(X: heptanoic acid)                 XELSKGCFGLKLDRIGSMSGLGC (SEQ ID NO:1129)
                                    GLSKGCFGLXLDRIGSMSGLGC  (SEQ ID NO:1130)
(X: Cit)                            GLSKGCFGLQLDRIGSMSGLGC  (SEQ ID NO:1131)
                                    GLSKGCFGLRLDRIGSMSGLGC  (SEQ ID NO:1132)
                                    GLSKGCFGLKLDRINSMSGLGC  (SEQ ID NO:1133)
                                    GLSKGCFGLKLDRISSMSGLGC  (SEQ ID NO:1134)
(all D-amino acids)                 GLSKGCFGLKLDRIGSMSGLGC  (SEQ ID NO:1135)
(X: N-Me-Leu)                       GLSKGCFGXKLDRIGSMSGLGC  (SEQ ID NO:1136)
(X: N-Me-Leu)                       GLSKGCFGLKXDRIGSMSGLGC  (SEQ ID NO:1137)
(X: N-Me-Leu)                       GLSKGCFGLKLDRIGSMSGXGC  (SEQ ID NO:1138)
(X: 3,4-dichloro-Phe)               GLSGGCXGLKLDRIGSMSGLGC  (SEQ ID NO:1139)
(X: 3-Me-Phe)                       GLSGGCXGLKLDRIGSMSGLGC  (SEQ ID NO:1140)
                                    GLSRSCFGLKLDRIGSMSGLGC  (SEQ ID NO:1141)
                                    GLSRRCFGLKLDRIGSMSGLGC  (SEQ ID NO:1142)
                                    GLSGGCFGLSLDRIGSMSGLGC  (SEQ ID NO:1143)
                                    GLSGGCFGLKLDRIGSMSGLGC  (SEQ ID NO:1144)
                                    GLSRGCFGLKLDRIGQMSGLGC  (SEQ ID NO:1145)
                                    GLSRGCFGLKLDRIGSNSGLGC  (SEQ ID NO:1146)
                                    GLSRGCFGLKLDRIGSMSSLGC  (SEQ ID NO:1147)
                                    GLSRGCFGLKLDRIGSMSRLGC  (SEQ ID NO:1148)
                                    GISRGCFGLKLDRIGSMSGRGC  (SEQ ID NO:1149)
                                    GLSRGCFGLKLDRIGSMSGLSC  (SEQ ID NO:1150)
                                    GLSRGCFGLKLDRIGSMSGLTC  (SEQ ID NO:1151)
                                    GLSRGCFGLKLDRIGSMSGLRC  (SEQ ID NO:1152)
(X: D-Phe)                          GLSKGCXGLKLDRIGSMSGLGC  (SEQ ID NO:1153)
(X: 3-Cl-Phe)                       GLSKGCXGLKLDRIGSMSGLGC  (SEQ ID NO:1154)
                                    RSSCFGGRISRIGACFFFFF    (SEQ ID NO:1155)
```

FIG. 29

CNP variants

```
CNP22                          GLSKGCFGLKLDRIGSMSGLGC                                                                          (SEQ ID NO:   4)
CNP-L17                        GLSKGCFGLKLDRIGSLSGLGC                                                                          (SEQ ID NO: 120)
CNP-F17                        GLSKGCFGLKLDRIGSFSGLGC                                                                          (SEQ ID NO: 119)
CNP-T17                        GLSKGCFGLKLDRIGSTSGLGC                                                                          (SEQ ID NO: 122)
D6-14AAlinker-CNP [C3]         DDDDDDGGGGSGGGGSGGGGSGLSKGCFGLKLDRIGSMSGLGC                                                     (SEQ ID NO: 147)
CNP-14AAlinker-D6 [C4]         GLSKGCFGLKLDRIGSMSGLGCGGGGSGGGGSGGGGDDDDDD
                                                                                                                              (SEQ ID NO: 148)
CNP-Nterm2 [C5]                ASTSPANPRPAASSGGLSKGCFGLKLDRIGSMSGLGC                                                           (SEQ ID NO: 150)
CDNP-S3A4A5R6 [C13]            GLSKGCFGLKLDRIGSMSGLGCPSSAARRPNAPSTSA
                                                                                                                              (SEQ ID NO: 115)
CDNP29-S3A4A5R6 [C14]          GLSKGCFGLKLDRIGSMSGLGCPSSAARR
                                                                                                                              (SEQ ID NO: 151)
C1(E6)  [BC1]                  EEEEEESGGGGSGGGGSGGGGGLSKGCFGLKLDRIGSMSGLGC                                                     (SEQ ID NO: 129)
C2(E6)  [BC2]                  EEEEEEASTSPANPQPAASSPGLSKGCFGLKLDRIGSMSGLGC                                                     (SEQ ID NO: 130)
C3(E6)  [BC3]                  EEEEEEPSSAAPQPNAPSTSAGLSKGCFGLKLDRIGSMSGLGC                                                     (SEQ ID NO: 131)
C4(E6)  [BC4]                  EEEEEESGGGGSGGGGKGANKKGLSKGCFGLKLDRIGSMSGLGC                                                    (SEQ ID NO: 132)
C5(E6)  [BC5]                  EEEEEESGGGGSGGGQGANQQGLSKGCFGLKLDRIGSMSGLGC                                                     (SEQ ID NO: 133)
C6(E6)  [BC6]                  EEEEEESGGGGSGGGGKGANQKGLSKGCFGLKLDRIGSMSGLGC                                                    (SEQ ID NO: 134)
C7(E6)  [BC7]                  EEEEEESGGGGSGGGGKGANQKGLSKGCFGLKLDRIGSMSGLGC                                                    (SEQ ID NO: 135)
C8(E6)  [BC8]                  EEEEEESGGGGSGGGQGANKKGLSKGCFGLKLDRIGSMSGLGC                                                     (SEQ ID NO: 136)
C9(E6)  [BC9]                  EEEEEESGGGGSGGGQGANQQGLSKGCFGLKLDRIGSMSGLGC                                                     (SEQ ID NO: 137)
C10(E6) [BC10]                 EEEEEESGGGGSGGGGKGANKGLSKGCFGLKLDRIGSMSGLGC                                                     (SEQ ID NO: 138)
C11(E6) [BC11]                 EEEEEESGGGGSGGGQGANKGLSKGCFGLKLDRIGSMSGLGC                                                      (SEQ ID NO: 139)
PGCNP37(E6)                    EEEEEEPGQEHPNARKYKGANKKGLSKGCFGLKLDRIGSMSGLGC                                                   (SEQ ID NO: 128)
KA1                            HGPQGQEHPNARKYKGANKKGLSKGCFGLKLDRIGSMSGLGC                                                      (SEQ ID NO: 152)
KA1(E6)                        EEEEEEHGPQGQEHPNARKYKGANKKGLSKGCFGLKLDRIGSMSGLGC                                                (SEQ ID NO: 153)
KB1                            HKLRGQEHPNARKYKGANKKGLSKGCFGLKLDRIGSMSGLGC                                                      (SEQ ID NO: 154)
KB1(E6)                        EEEEEEHKLRGQEHPNARKYKGANKKGLSKGCFGLKLDRIGSMSGLGC                                                (SEQ ID NO: 155)
```

FIG. 30

CNP variants having Point Mutations at Position 17

| | | |
|---|---|---|
| CNP-X17 | GLSKGCFGLKLDRIGSXSGLGC | (SEQ ID NO: 126) |
| CNP-F17 | GLSKGCFGLKLDRIGSFSGLGC | (SEQ ID NO: 119) |
| CNP-L17 | GLSKGCFGLKLDRIGSLSGLGC | (SEQ ID NO: 120) |
| CNP-I17 | GLSKGCFGLKLDRIGSISGLGC | (SEQ ID NO: 121) |
| CNP-T17 | GLSKGCFGLKLDRIGSTSGLGC | (SEQ ID NO: 122) |
| CNP-E17 | GLSKGCFGLKLDRIGSESGLGC | (SEQ ID NO: 156) |
| CNP-R17 | GLSKGCFGLKLDRIGSRSGLGC | (SEQ ID NO: 157) |
| CNP-Y17 | GLSKGCFGLKLDRIGSYSGLGC | (SEQ ID NO: 158) |
| CNP-C17 | GLSKGCFGLKLDRIGSCSGLGC | (SEQ ID NO: 159) |
| CNP-P17 | GLSKGCFGLKLDRIGSPSGLGC | (SEQ ID NO: 160) |
| CNP-D17 | GLSKGCFGLKLDRIGSDSGLGC | (SEQ ID NO: 161) |
| CNP37-X17 | QEHPNARKYKGANKKGLSKGCFGLKLDRIGSXSGLGC | (SEQ ID NO: 162) |
| CNP37-F17 | QEHPNARKYKGANKKGLSKGCFGLKLDRIGSFSGLGC | (SEQ ID NO: 163) |
| CNP37-L17 | QEHPNARKYKGANKKGLSKGCFGLKLDRIGSLSGLGC | (SEQ ID NO: 164) |
| CNP37-I17 | QEHPNARKYKGANKKGLSKGCFGLKLDRIGSISGLGC | (SEQ ID NO: 165) |
| CNP37-T17 | QEHPNARKYKGANKKGLSKGCFGLKLDRIGSTSGLGC | (SEQ ID NO: 166) |
| CNP37-E17 | QEHPNARKYKGANKKGLSKGCFGLKLDRIGSESGLGC | (SEQ ID NO: 167) |
| CNP37-R17 | QEHPNARKYKGANKKGLSKGCFGLKLDRIGSRSGLGC | (SEQ ID NO: 168) |
| CNP37-Y17 | QEHPNARKYKGANKKGLSKGCFGLKLDRIGSYSGLGC | (SEQ ID NO: 169) |
| CNP37-C17 | QEHPNARKYKGANKKGLSKGCFGLKLDRIGSCSGLGC | (SEQ ID NO: 170) |
| CNP37-P17 | QEHPNARKYKGANKKGLSKGCFGLKLDRIGSPSGLGC | (SEQ ID NO: 171) |
| CNP37-D17 | QEHPNARKYKGANKKGLSKGCFGLKLDRIGSDSGLGC | (SEQ ID NO: 172) |

FIG. 31A

Additional CNP variants having Point Mutations at Position 17

| | | |
|---|---|---|
| KA1-X17 | HGPQGQEHPNARKYKGANKKGLSKGCFGLKLDRIGSXSGLGC | (SEQ ID NO: 173) |
| KA2-X17 | SGGGGQEHPNARKYKGANKKGLSKGCFGLKLDRIGSXSGLGC | (SEQ ID NO: 174) |
| KA3-X17 | GGGHGPQGQEHPNARKYKGANKKGLSKGCFGLKLDRIGSXSGLGC | (SEQ ID NO: 175) |
| KA4-X17 | GGGSGGGGQEHPNARKYKGANKKGLSKGCFGLKLDRIGSXSGLGC | (SEQ ID NO: 176) |
| KA5-X17 | SGGGSGGGGSGGGKGANKKGLSKGCFGLKLDRIGSXSGLGC | (SEQ ID NO: 177) |
| KA6-X17 | HGPQGSGGGSGGGKGANKKGLSKGCFGLKLDRIGSXSGLGC | (SEQ ID NO: 178) |
| KA7-X17 | GGGSGGGGSGGGSGGGKGANKKGLSKGCFGLKLDRIGSXSGLGC | (SEQ ID NO: 179) |
| KA8-X17 | GGGHGPQGSGGGSGGGKGANKKGLSKGCFGLKLDRIGSXSGLGC | (SEQ ID NO: 180) |
| KB1-X17 | HKLRGQEHPNARKYKGANKKGLSKGCFGLKLDRIGSXSGLGC | (SEQ ID NO: 181) |
| KB2-X17 | GGGHKLRGQEHPNARKYKGANKKGLSKGCFGLKLDRIGSXSGLGC | (SEQ ID NO: 182) |
| KB3-X17 | HKLRGSGGGGKGANKKGLSKGCFGLKLDRIGSXSGLGC | (SEQ ID NO: 183) |
| KB4-X17 | GGGHKLRGSGGGGKGANKKGLSKGCFGLKLDRIGSXSGLGC | (SEQ ID NO: 184) |
| PGCNP37-X17 | PGQEHPNARKYKGANKKGLSKGCFGLKLDRIGSXSGLGC | (SEQ ID NO: 185) |
| KA1(E6)-X17 | EEEEEEHGPQGQEHPNARKYKGANKKGLSKGCFGLKLDRIGSXSGLGC | (SEQ ID NO: 186) |
| KA2(E6)-X17 | EEEEEESGGGGQEHPNARKYKGANKKGLSKGCFGLKLDRIGSXSGLGC | (SEQ ID NO: 187) |
| KA3(E6)-X17 | EEEEEEGGGHGPQGQEHPNARKYKGANKKGLSKGCFGLKLDRIGSXSGLGC | (SEQ ID NO: 188) |
| KA4(E6)-X17 | EEEEEEGGGSGGGGQEHPNARKYKGANKKGLSKGCFGLKLDRIGSXSGLGC | (SEQ ID NO: 189) |
| KA5(E6)-X17 | EEEEEESGGGSGGGGSGGGKGANKKGLSKGCFGLKLDRIGSXSGLGC | (SEQ ID NO: 190) |
| KA6(E6)-X17 | EEEEEEHGPQGSGGGSGGGKGANKKGLSKGCFGLKLDRIGSXSGLGC | (SEQ ID NO: 191) |
| KA7(E6)-X17 | EEEEEEGGGSGGGGSGGGSGGGKGANKKGLSKGCFGLKLDRIGSXSGLGC | (SEQ ID NO: 192) |
| KA8(E6)-X17 | EEEEEEGGGHGPQGSGGGSGGGKGANKKGLSKGCFGLKLDRIGSXSGLGC | (SEQ ID NO: 193) |
| KB1(E6)-X17 | EEEEEEHKLRGQEHPNARKYKGANKKGLSKGCFGLKLDRIGSXSGLGC | (SEQ ID NO: 194) |
| KB2(E6)-X17 | EEEEEEGGGHKLRGQEHPNARKYKGANKKGLSKGCFGLKLDRIGSXSGLGC | (SEQ ID NO: 195) |
| KB3(E6)-X17 | EEEEEEHKLRGSGGGGKGANKKGLSKGCFGLKLDRIGSXSGLGC | (SEQ ID NO: 196) |
| KB4(E6)-X17 | EEEEEEGGGHKLRGSGGGGKGANKKGLSKGCFGLKLDRIGSXSGLGC | (SEQ ID NO: 197) |
| E6PGCNP37-X17 | EEEEEEPGQEHPNARKYKGANKKGLSKGCFGLKLDRIGSXSGLGC | (SEQ ID NO: 198) |

FIG. 31B

Additional CNP variants having Point Mutations at Position 17

| | | |
|---|---|---|
| C1(E6)-X17 | EEEEEE SGGGGSGGGGSGGGGG LSKGCFGLKLDRIGSXSGLGC | (SEQ ID NO: 199) |
| C2(E6)-X17 | EEEEEE ASTSPANPQPAASSPGLSKGCFGLKLDRIGSXSGLGC | (SEQ ID NO: 200) |
| C3(E6)-X17 | EEEEEE PSSAAPQPNAPSTSAGLSKGCFGLKLDRIGSXSGLGC | (SEQ ID NO: 201) |
| C4(E6)-X17 | EEEEEE SGGGGSGGGKGANKKGLSKGCFGLKLDRIGSXSGLGC | (SEQ ID NO: 202) |
| C5(E6)-X17 | EEEEEE SGGGGSGGGQGANQQGLSKGCFGLKLDRIGSXSGLGC | (SEQ ID NO: 203) |
| C6(E6)-X17 | EEEEEE SGGGGSGGGKGANKQGLSKGCFGLKLDRIGSXSGLGC | (SEQ ID NO: 204) |
| C7(E6)-X17 | EEEEEE SGGGGSGGGKGANQKGLSKGCFGLKLDRIGSXSGLGC | (SEQ ID NO: 205) |
| C8(E6)-X17 | EEEEEE SGGGGSGGGQGANQKGLSKGCFGLKLDRIGSXSGLGC | (SEQ ID NO: 206) |
| C9(E6)-X17 | EEEEEE SGGGGSGGGQGANKKGLSKGCFGLKLDRIGSXSGLGC | (SEQ ID NO: 207) |
| C10(E6)-X17 | EEEEEE SGGGGSGGGQGANQQGLSKGCFGLKLDRIGSXSGLGC | (SEQ ID NO: 208) |
| C11(E6)-X17 | EEEEEE SGGGGSGGGGQGANKKGLSKGCFGLKLDRIGSXSGLGC | (SEQ ID NO: 209) |
| D6CNP37-X17 | DDDDDD QEHPNARKYKGANKKGLSKGCFGLKLDRIGSXSGLGC | (SEQ ID NO: 210) |
| C1(D6)-X17 | DDDDDD SGGGGSGGGGSGGGG LSKGCFGLKLDRIGSXSGLGC | (SEQ ID NO: 211) |
| C2(D6)-X17 | DDDDDD DASTSPANPQPAASSGGLSKGCFGLKLDRIGSXSGLGC | (SEQ ID NO: 212) |
| C3(D6)-X17 | DDDDDD GSSAAPQPNAPSTSAGLSKGCFGLKLDRIGSXSGLGC | (SEQ ID NO: 213) |
| C4(D6)-X17 | DDDDDD SGGGGSGGGKGANKKGLSKGCFGLKLDRIGSXSGLGC | (SEQ ID NO: 214) |
| C5(D6)-X17 | DDDDDD SGGGGSGGGQGANQQGLSKGCFGLKLDRIGSXSGLGC | (SEQ ID NO: 215) |
| C6(D6)-X17 | DDDDDD SGGGGSGGGKGANQKGLSKGCFGLKLDRIGSXSGLGC | (SEQ ID NO: 216) |
| D6-14AAlinker-CNP-X17 | DDDDDD DGGGGSGGGGSGGGG LSKGCFGLKLDRIGSXSGLGC | (SEQ ID NO: 217) |
| CNP-14AAlinker-D6-X17 | GLSKGCFGLKLDRIGSXSGLGC*GGGGSGGGGSGGGGDDDDDD* (SEQ ID NO: 218) | |
| CNP-Nterm1-X17 | *GSSAAPRPNAPSTSAG*LSKGCFGLKLDRIGSXSGLGC | (SEQ ID NO: 219) |
| CNP-Nterm2-X17 | *ASTSPANPRPAASSGG*LSKGCFGLKLDRIGSXSGLGC | (SEQ ID NO: 220) |

FIG. 32

CNP variants having M17L

| | | |
|---|---|---|
| KA1(E6)-L17 | EEEEEEHGPQGQEHPNARKYKGANKKGLSKGCFGLKLDRIGSLSGLGC | (SEQ ID NO: 221) |
| KA2(E6)-L17 | EEEEEESGGGGQEHPNARKYKGANKKGLSKGCFGLKLDRIGSLSGLGC | (SEQ ID NO: 222) |
| KA3(E6)-L17 | EEEEEEGGGHGPQGQEHPNARKYKGANKKGLSKGCFGLKLDRIGSLSGLGC | (SEQ ID NO: 223) |
| KA4(E6)-L17 | EEEEEEGGGSGGGQEHPNARKYKGANKKGLSKGCFGLKLDRIGSLSGLGC | (SEQ ID NO: 224) |
| KA5(E6)-L17 | EEEEEESGGGSGGGGSGGGKGANKKGLSKGCFGLKLDRIGSLSGLGC | (SEQ ID NO: 225) |
| KA6(E6)-L17 | EEEEEEHGPQGSGGGGSGGGGSGGGKGANKKGLSKGCFGLKLDRIGSLSGLGC | (SEQ ID NO: 226) |
| KA7(E6)-L17 | EEEEEEGGGSGGGGSGGGGSGGGKGANKKGLSKGCFGLKLDRIGSLSGLGC | (SEQ ID NO: 227) |
| KA8(E6)-L17 | EEEEEEGGGHGPQGSGGGGSGGGGSGGGKGANKKGLSKGCFGLKLDRIGSLSGLGC | (SEQ ID NO: 228) |
| KB1(E6)-L17 | EEEEEEHKLRGQEHPNARKYKGANKKGLSKGCFGLKLDRIGSLSGLGC | (SEQ ID NO: 229) |
| KB2(E6)-L17 | EEEEEEGGGHKLRGQEHPNARKYKGANKKGLSKGCFGLKLDRIGSLSGLGC | (SEQ ID NO: 230) |
| KB3(E6)-L17 | EEEEEEHKLRGSGGGGSGGGKGANKKGLSKGCFGLKLDRIGSLSGLGC | (SEQ ID NO: 231) |
| KB4(E6)-L17 | EEEEEEGGGHKLRGSGGGGSGGGGSGGGKGANKKGLSKGCFGLKLDRIGSLSGLGC | (SEQ ID NO: 232) |
| E6PGCNP37-L17 | EEEEEEPGQEHPNARKYKGANKKGLSKGCFGLKLDRIGSLSGLGC | (SEQ ID NO: 233) |

FIG. 33A

NC2st-X17 and NC2B-X17 Protein Sequences

NC2st-X17
(w/ sig. seq.)

MGVHECPAWLWLLLSLLSLMWPGAYAASWSHPQFEQSGGGGENLYFQGGDKTHTCPPCPAPELLGGPSVFLFP
PKPKDTLMISRTPEVTCVVVDVSHEDPEVKFNWYVDGVEVHNAKTKPREEQYNSTYRVVSVLTVLHQDWLNGK
EYKCKVSNKALPAPIEKTISKAKGQPREPQVYTLPPSREEMTKNQVSLTCLVKGFYPSDIAVEWESNGQPENN
YKTTPPVLDSDGSFFLYSKLTVDKSRWQQGNVFSCSVMHEALHNHYTQKSLSLSPGK*GGGGSGGGGSGGGGSG
GLSKGCFGLKLDRIGSXSGLGC* (SEQ ID NO: 527)

NC2st-X17
(w/o sig. seq.)

ASWSHPQFEQSGGGGENLYFQGGDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK*GGGGSGGGGSGGGGSGGLSKGCFGLKLDRIGSXSGLGC*
(SEQ ID NO: 528)

NC2B-X17
(w/ sig. seq.)

MGVHECPAWLWLLLSLLSLMWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGLSKGCFGLKLDRIGSXSGLGC*
(SEQ ID NO: 529)

NC2B-X17
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSGGLSKGCFGLKLDRIGSXSGLGC* (SEQ ID NO: 530)

FIG. 33B

NC2B-22-X17, NC2B-28-X17, and NC2B-34-X17 Sequences

NC2B-22-X17
(w/sig. seq.)

MGVHECPAWLWLLLSLLSLMPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGGGGSKCFGLKCED RIGSXSGLGC* (SEQ ID NO: 531)

NC2B-22-X17
(w/o sig. seq.)

DKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SLSLSPGK*GGGGSGGGGSGGGGSGGGGGSKCFGLKCED RIGSXSGLGC* (SEQ ID NO: 532)

NC2B-28-X17
(w/sig. seq.)

MGVHECPAWLWLLLSLLSLMPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGGGGSKCFGLKSNCFGLKNCFD RIGSXSGLGC* (SEQ ID NO: 533)

NC2B-28-X17
(w/o sig. seq.)

DKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SLSLSPGK*GGGGSGGGGSGGGGSGGGGGSKCFGLKSNCFGLKNCFD RIGSXSGLGC* (SEQ ID NO: 534)

NC2B-34-X17
(w/sig. seq.)

MGVHECPAWLWLLLSLLSLMPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGGGGSLSKCFGLKLERIGSXSGLGC* (SEQ ID NO: 535)

NC2B-34-X17
(w/o sig. seq.)

DKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SLSLSPGK*GGGGSGGGGSGGGGSGGGGGSLSKCFGLKLERIGSXSGLGC* (SEQ ID NO: 536)

FIG. 33C
NC2-X17 Variants

NC2-KGANKK-X17 (w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGS*KGANKK*SKGFGLKLDRIGSXXEGC*
(SEQ ID NO: 537)

NC2-KGANKK-X17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGS*KGANKK*SKGFGLKLDRIGSXXEGC* (SEQ ID NO: 538)

NC2-KGANQK-X17 (w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGS*KGANQK*SKGFGLKLDRIGSXXEGC*
(SEQ ID NO: 539)

NC2-KGANQK-X17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGS*KGANQK*SKGFGLKLDRIGSXXEGC* (SEQ ID NO: 540)

NC2-CNP53mut2-X17 (w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLQVDTQSQAAWAQLLQEHPNAQQYKGANKK*SKGFGLKLDRIGSXXEGC*
(SEQ ID NO: 541)

NC2-CNP53mut2-X17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLQVDTQSQAAWAQLLQEHPNAQQYKGANKK*SKGFGLKLDRIGSXXEGC* (SEQ ID NO: 542)

FIG. 33D

Fc-CNP53-X17 Constructs

Fc-CNP53-X17
(w/sig. seq.)

MGVHECPAWLWLLLSLLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLRVDTKSRAAWARLLQEHPNARKYKGANKKGLSKGC*
*FGLKLDRIGSXSGLGC* (SEQ ID NO: 543)

Fc-CNP53-X17
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLRVDTKSRAAWARLLQEHPNARKYKGANKKGLSKGCFGLKLDRIGSXSGLGC* (SEQ ID
NO: 544)

Fc-CNP53-AA-X17
(w/sig. seq.)

MGVHECPAWLWLLLSLLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLRVDTKSRAAWARLLQEHPNARKYKGANAAGLSKGC*
*FGLKLDRIGSXSGLGC* (SEQ ID NO: 545)

Fc-CNP53-AA-X17
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLRVDTKSRAAWARLLQEHPNARKYKGANAAGLSKGCFGLKLDRIGSXSGLGC* (SEQ ID
NO: 546)

FIG. 33E

Constructs Having N-terminal NP-X17 fused to C-terminal Fc Domain

CNP-X17-16AAlinker-Fc-His₁₀ (NC1)
GLSKGCFGLKLDRIGSXSGLGCGGGGSGGGGSGGGGSGDKTHTCPPCPAPELLGGPSVFLFPPKPKDTLMISR
TPEVTCVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGKGENLYFQGSHHHHHHHHHH (SEQ
ID NO: 547)

CNP-X17-6AAlinker-Fc-His₁₀ (NC3)
GLSKGCFGLKLDRISSXSGLGCGGGGSDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGKGENLYFQGSHHHHHHHHHH (SEQ ID NO: 548)

CNP-X17-6AAlinker-Fc
GLSKGCFGLKLDRIGSXSGLGCGGGGSDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK (SEQ ID NO: 549)

CDNP-X17-Fc
GLSKGCFGLKLDRISSXSGLGCPSSRDPRKNRSTSDKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 550)

CDNP-X17-saa-Fc
GLSKGCFGLKLDRISSXSGLGCPSSAAPRENARSTSDKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 551)

CDNP-X17-sra-Fc
GLSKGCFGLKLDRISSXSGLGCPSSRAPRENARSTSDKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 552)

FIG. 34A
NC2 Variants

NC2-KGANKK
(w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSKGANKK*SKCFRKKLKQIGKSYGC
(SEQ ID NO: 511)

NC2-KGANKK
(w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSKGANKK*SKCFRKKLKQIGKSYGC (SEQ ID NO: 512)

NC2-KGANQK
(w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSKGANQK*SKCFRKKLKQIGKSYGC
(SEQ ID NO: 513)

NC2-KGANQK
(w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSKGANQK*SKCFRKKLKQIGKSYGC (SEQ ID NO: 514)

NC2-CNP53mut2
(w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLQVDTQSQAAWAQLLQEHPNAQQYKGANKK*SKCF
RKKLKQIGKSYGC (SEQ ID NO: 515)

NC2-CNP53mut2
(w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLQVDTQSQAAWAQLLQEHPNAQQYKGANKK*SKCFRKKLKQIGKSYGC (SEQ ID
NO: 516)

FIG. 34B
D10-NC2 Variants

D10-NC2-KGANKK (w/sig. seq.)
MGVHECPAWLMLLSLLSLWPGAYADDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANKKGSKHGLKK (SEQ ID NO: 553)

D10-NC2-KGANKK (w/o sig. seq.)
DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANKKGSKHGLKK (SEQ ID NO: 554)

D10-NC2-KGANQK (w/sig. seq.)
MGVHECPAWLMLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANQKGSKHGLKK (SEQ ID NO: 555)

D10-NC2-KGANQK (w/o sig. seq.)
DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANQKGSKHGLKK (SEQ ID NO: 556)

D10-NC2-CNP53mut2 (w/sig. seq.)
MGVHECPAWLMLLSLLSLWPGAYADDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGDLQVDTQSQAAWAQLLQEHPNAQQYKGANKKGSKHGLKK (SEQ ID NO: 557)

D10-NC2-CNP53mut2 (w/o sig. seq.)
DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGDLQVDTQSQAAWAQLLQEHPNAQQYKGANKKGSKHGLKK (SEQ ID NO: 558)

FIG. 34C
NC2-F17 Variants

NC2-KGANKK-F17 (w/ sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGGSGGGGSGGGGSKGANKK*KCETLRTGSFSGKG* (SEQ ID NO: 559)

NC2-KGANKK-F17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGGSGGGGSGGGGSKGANKK*KCETLRTGSFSGKG* (SEQ ID NO: 560)

NC2-KGANQK-F17 (w/ sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGGSGGGGSGGGGSKGANQK*KCETLRTGSFSGKG* (SEQ ID NO: 561)

NC2-KGANQK-F17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGGSGGGGSGGGGSKGANQK*KCETLRTGSFSGKG* (SEQ ID NO: 562)

NC2-CNP53mut2-F17 (w/ sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGDLQVDTQSQAAWAQLLQEHPNAQQYKGANKK*KCETLRTGSFSGKG* (SEQ ID NO: 563)

NC2-CNP53mut2-F17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGDLQVDTQSQAAWAQLLQEHPNAQQYKGANKK*KCETLRTGSFSGKG* (SEQ ID NO: 564)

FIG. 34D
D10-NC2-F17 Variants

D10-NC2-KGANKK-F17
(w/sig. seq.)

MGVHECPAWLMLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANKKGFSKCELRVKFSR (SEQ ID NO: 565)

D10-NC2-KGANKK-F17
(w/o sig. seq.)

DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANKKGFSKCELRVKFSR (SEQ ID NO: 566)

D10-NC2-KGANQK-F17
(w/sig. seq.)

MGVHECPAWLMLLLSLLSLWPGAYADDDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANQKGFSKCELRVKFSR (SEQ ID NO: 567)

D10-NC2-KGANQK-F17
(w/o sig. seq.)

DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANQKGFSKCELRVKFSR (SEQ ID NO: 568)

D10-NC2-CNP53mut2-F17
(w/sig. seq.)

MGVHECPAWLMLLLSLLSLWPGAYADDDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGDLQVDTQSQAAWAQLLQEHPNAQQYKG
ANKKGFSKCELRVKFSR (SEQ ID NO: 569)

D10-NC2-CNP53mut2-F17
(w/o sig. seq.)

DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGDLQVDTQSQAAWAQLLQEHPNAQQYKGANKKGFSKCELRVKFSR (SEQ ID NO: 570)

FIG. 34E
NC2-L17 Variants

NC2-KGANKK-L17 (w/ sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSGSFFLYSKLTVDK
SRWQQGNVFSCSVMHEALHNHYTQKSLSLSPGKGGGGSGGGGSGGGGSKGANKKGCFGLKLRIGSTSGSGC
(SEQ ID NO: 571)

NC2-KGANKK-L17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGGSGGGGSGGGGSKGANKKGCFGLKLDRIGSTSGSGC (SEQ ID NO: 572)

NC2-KGANQK-L17 (w/ sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGGSGGGGSGGGGSKGANQKGCFGLKLDRIGSTSGSGC
(SEQ ID NO: 573)

NC2-KGANQK-L17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGGSGGGGSGGGGSKGANQKGCFGLKLDRIGSTSGSGC (SEQ ID NO: 574)

NC2-CNP53mut2-L17 (w/ sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGDLQVDTQSQAAWAQLLQEHPNAQQYKGANKKGCFGLKLDRIGSTSGSGC
(SEQ ID NO: 575)

NC2-CNP53mut2-L17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGDLQVDTQSQAAWAQLLQEHPNAQQYKGANKKGCFGLKLDRIGSTSGSGC (SEQ ID NO: 576)

FIG. 34F
D10-NC2-L17 Variants

D10-NC2-KGANKK-L17 (w/sig. seq.)

MGVHECPAWLMLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANKKGLFGLGG (SEQ ID NO: 577)

D10-NC2-KGANKK-L17 (w/o sig. seq.)

DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANKKGLFGLGG (SEQ ID NO: 578)

D10-NC2-KGANQK-L17 (w/sig. seq.)

MGVHECPAWLMLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANQKGLFGLGG (SEQ ID NO: 579)

D10-NC2-KGANQK-L17 (w/o sig. seq.)

DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANQKGLFGLGG (SEQ ID NO: 580)

D10-NC2-CNP53mut2-L17 (w/sig. seq.)

MGVHECPAWLMLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGDLQVDTQSQAAWAQLLQEHPNAQQYKG
ANKKGLFGLGG (SEQ ID NO: 581)

D10-NC2-CNP53mut2-L17 (w/o sig. seq.)

DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGDLQVDTQSQAAWAQLLQEHPNAQQYKGANKKGLFGLGG (SEQ ID NO: 582)

FIG. 34G
NC2-R17 Variants

NC2-KGANKK-R17 (w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGGSGGGGSKGANKK*GKCFGLKLDRIGSRKSGG*
(SEQ ID NO: 583)

NC2-KGANKK-R17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGGSGGGGSKGANKK*GKCFGLKLDRIGSRKSGG* (SEQ ID NO: 584)

NC2-KGANQK-R17 (w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGGSGGGGSKGANQK*GKCFGLKLDRIGSRKSGG*
(SEQ ID NO: 585)

NC2-KGANQK-R17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGGSGGGGSKGANQK*GKCFGLKLDRIGSRKSGG* (SEQ ID NO: 586)

NC2-CNP53mut2-R17 (w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGDLQVDTQSQAAWAQLLQEHPNAQQYKGANKK*GKCFGLKLDRIGSRKSGG*
(SEQ ID NO: 587)

NC2-CNP53mut2-R17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGDLQVDTQSQAAWAQLLQEHPNAQQYKGANKK*GKCFGLKLDRIGSRKSGG* (SEQ ID
NO: 588)

FIG. 34H
D10-NC2-R17 Variants

D10-NC2-KGANKK-R17 (w/sig. seq.)
MGVHECPAWLWLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANKK░░░░░░░░░░░░
░░░░░░░░ (SEQ ID NO: 589)

D10-NC2-KGANKK-R17 (w/o sig. seq.)
DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANKK░░░░░░░░░░░░░░░░░░░░ (SEQ ID NO: 590)

D10-NC2-KGANQK-R17 (w/sig. seq.)
MGVHECPAWLWLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANQK░░░░░░░░░░░░
░░░░░░░░ (SEQ ID NO: 591)

D10-NC2-KGANQK-R17 (w/o sig. seq.)
DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANQK░░░░░░░░░░░░░░░░░░░░ (SEQ ID NO: 592)

D10-NC2-CNP53mut2-R17 (w/sig. seq.)
MGVHECPAWLWLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGDLQVDTQSQAAWAQLLQEHPNAQQYKG
ANKK░░░░░░░░░░░░░░░░░░░░ (SEQ ID NO: 593)

D10-NC2-CNP53mut2-R17 (w/o sig. seq.)
DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGDLQVDTQSQAAWAQLLQEHPNAQQYKGANKK░░░░░░░░░░░░░░░░░░░░
░ (SEQ ID NO: 594)

FIG. 34I
NC2-Y17 Variants

NC2-KGANKK-Y17 (w/sig. seq.)
MGVHECPAWLMLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSKGANKK*⬚⬚⬚⬚⬚⬚⬚⬚⬚⬚⬚⬚⬚⬚⬚⬚⬚⬚⬚
(SEQ ID NO: 595)

NC2-KGANKK-Y17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSKGANKK*⬚⬚⬚⬚⬚⬚⬚⬚⬚⬚⬚⬚⬚⬚⬚⬚⬚⬚⬚ (SEQ ID NO: 596)

NC2-KGANQK-Y17 (w/sig. seq.)
MGVHECPAWLMLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSKGAN*QK⬚⬚⬚⬚⬚⬚⬚⬚⬚⬚⬚⬚⬚⬚⬚⬚⬚
(SEQ ID NO: 597)

NC2-KGANQK-Y17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSKGANQK*⬚⬚⬚⬚⬚⬚⬚⬚⬚⬚⬚⬚⬚⬚⬚⬚⬚⬚⬚ (SEQ ID NO: 598)

NC2-CNP53mut2-Y17 (w/sig. seq.)
MGVHECPAWLMLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLQVDTQSQAAWAQLLQEHPNAQQYKGANKK*⬚⬚⬚⬚⬚⬚⬚⬚⬚ (SEQ ID NO: 599)

NC2-CNP53mut2-Y17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLQVDTQSQAAWAQLLQEHPNAQQYKGANKK*⬚⬚⬚⬚⬚⬚⬚⬚⬚⬚⬚⬚⬚⬚⬚⬚⬚⬚⬚ (SEQ ID NO: 600)

FIG. 34J
D10-NC2-Y17 Variants

D10-NC2-KGANKK-Y17 (w/ sig. seq.)
MGVHECPAWLMLLLSLLSLMPGAYADDDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANKKGLSKGCFGLKLDRI
GSYSGLGC (SEQ ID NO: 601)

D10-NC2-KGANKK-Y17 (w/o sig. seq.)
DDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANKKGLSKGCFGLKLDRIGSYSGLGC (SEQ ID NO: 602)

D10-NC2-KGANQK-Y17 (w/ sig. seq.)
MGVHECPAWLMLLLSLLSLMPGAYADDDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANQKGLSKGCFGLKLDRI
GSYSGLGC (SEQ ID NO: 603)

D10-NC2-KGANQK-Y17 (w/o sig. seq.)
DDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANQKGLSKGCFGLKLDRIGSYSGLGC (SEQ ID NO: 604)

D10-NC2-CNP53mut2-Y17 (w/ sig. seq.)
MGVHECPAWLMLLLSLLSLMPGAYADDDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGDLQVDTQSQAAWAQLLQEHPNAQQYKG
ANKKGLSKGCFGLKLDRIGSYSGLGC (SEQ ID NO: 605)

D10-NC2-CNP53mut2-Y17 (w/o sig. seq.)
DDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGDLQVDTQSQAAWAQLLQEHPNAQQYRGANKKGLSKGCFGLKLDRIGSYSGLG
C (SEQ ID NO: 606)

COMPOSITIONS COMPRISING ALKALINE PHOSPHATASE AND/OR NATRIURETIC PEPTIDE AND METHODS OF USE THEREOF

CROSS-REFERENCE TO RELATED APPLICATIONS

This application claims the benefit of U.S. Provisional Application 61/649,717 filed on May 21, 2012, which is hereby incorporated by reference in its entirety.

STATEMENT AS TO FEDERALLY FUNDED RESEARCH

This invention was made with government support under grant numbers 5RO1AR055966-02 and W81XWH-09-01-0207) awarded by the NIH and Department of Defense, respectively. The government has certain rights in this invention.

BACKGROUND OF THE INVENTION

In general, this invention relates to the treatment of various diseases using alkaline phosphatase and/or natriuretic peptide.

Numerous diseases and conditions involve abnormal skeletal function, structure, or growth of bone or cartilage. For some diseases, the etiology of these skeletal manifestations is known, such as in hypophosphatasia (HPP) and achondroplasia (ACH), but treatment options are limited. In other diseases, the etiology is unknown. For example, neurofibromatosis type I (NF1 or Von Recklinghausen disease) is an autosomal dominant genetic disorder having an incidence of approximately 1 in 3,500 live births. NF1 encodes neurofibromin, a member of the GTPase Activating Protein (GAP) family known to suppress the Ras kinase. Neurofibromin is a specific suppressor of p21-RAS, and mutations in the NF1 gene cause unsuppressed activation of RAS that lead to abnormal cell growth and differentiation. Accordingly, the clinical features of NF1 include various oncogenic transformations, such as neurocutaneous neurofibromas and optic pathway tumors, and other non-cancer manifestations, such as cognitive defects and skeletal abnormalities. Some of the NF1 skeletal manifestations have high morbidity (e.g., dystrophic scoliosis, long bone bowing, and pseudarthrosis) and unsatisfactory treatment options, which has been complicated by the fact that the etiology of these manifestations is unclear.

Many skeletal diseases arise from loss of function of one or more proteins. For example, hypophosphatasia (HPP) is a rare, heritable disease caused by one or more loss-of-function mutations in the gene ALPL, which encodes tissue-nonspecific alkaline phosphatase (TNALP; a.k.a. liver/bone/kidney type ALP). Alkaline phosphatase deficiency in osteoblasts and chondrocytes impairs skeletal mineralization, leading to symptoms of varying severity, from rickets or osteomalacia to almost complete absence of bone mineralization in utero. However, enzyme replacement therapy with unmodified alkaline phosphatase (e.g., infusion of native alkaline phosphatase) has been largely unsuccessful.

In another example, achondroplasia (ACH) is the most common form of short limb dwarfism in human beings, affecting more than 250,000 individuals worldwide, and is caused by mutations in the gene encoding fibroblast growth factor receptor 3 (FGFR3), which cause gain of FGFR3 function. The severity of the clinical phenotype is related to the capacity of the mutation to overactivate FGFR3 signaling pathways in chondrocytes, such as the MAP-kinase pathway. This pathway can be inhibited by activating the natriuretic peptide receptor B (NPR-B), which produces the second messenger cGMP, and cGMP, in turn, inhibits the MAP-kinase pathway inside the cell. In the cellular environment, the immature and mature forms of C-type natriuretic peptide (CNP), such as CNP53 and CNP22, bind to NPR-B and induce cGMP production in a dose-dependent and similar fashion. Thus, use of CNP or a CNP analog that could activate the NPR-B signaling pathway for the treatment of skeletal dysplasia has been considered. However, a major drawback of the therapeutic use of CNP is its extremely short half-life.

There is thus a need in the art to develop therapeutic molecules and methods for treating diseases having skeletal manifestations, such as neurofibromatosis. In addition, more therapeutic molecules are needed that have an appreciable half-life and/or other favorable pharmacokinetic and therapeutic properties, and these molecules can be used to treat a variety of disorders that would benefit from their underlying mode of action, such as neurofibromatosis, hypophosphatasia, and achondroplasia.

SUMMARY OF THE INVENTION

It has surprisingly been discovered that neurofibromatosis, a neurocutaneous syndrome resulting in tumors in the nervous system, results in bone manifestations that arise from accumulation of inorganic pyrophosphate ($PP_i$). As alkaline phosphatase-Fc fusion proteins (either with or without a bone-targeting moiety) can reduce $PP_i$ accumulation, the present invention provides a polypeptide including a soluble alkaline phosphatase (sALP) domain (i.e., an sALP polypeptide), as well as compositions and uses thereof. In addition, bone manifestations in neurofibromatosis may also arise from overactivation of the MAP-kinase pathway, and a natriuretic peptide (NP) or NP analog could be used to inhibit this pathway. Accordingly, the present invention provides a polypeptide including an NP (e.g., a CNP) domain (i.e., an NP polypeptide) and compositions and uses thereof.

Furthermore, the present invention includes a combination of an sALP polypeptide and an NP polypeptide, where these polypeptides can be administered separately or together. This combination would be particularly useful in diseases that would benefit from increased ALP levels (e.g., disorders associated with increased levels of PPi, such as neurofibromatosis, or disorders associated with ALP deficiency, such as hypophosphatasia) and/or diseases that would benefit from inactivation of a signaling pathway involving FGFR3 (e.g., disorders associated with overactivation of the MAP-kinase pathway, such as neurofibromatosis or achondroplasia, or disorders associated with overactivation of FGFR3, such as achondroplasia or craniosynostosis or cancer) and/or diseases that would benefit from increased NP levels (e.g., disorders associated with CNP deficiency, such as skeletal dysplasia, or vascular smooth muscle disorders). The polypeptides of the invention can also be provided in kits, either separately or together.

In a first aspect, the invention features a method of treating a neurocutaneous syndrome in a subject, the method including administering to the subject a therapeutically effective amount of a pharmaceutical composition including: (a) a polypeptide including the structure A-sALP-B; and (b) a pharmaceutically acceptable excipient, where sALP is the extracellular domain of an alkaline phosphatase, A is absent or is an amino acid sequence of at least one amino acid, and B is absent or is an amino acid sequence of at least one amino acid. In some embodiments, the syndrome in the subject is thereby treated.

In some embodiments, the amino acid sequence of the sALP includes or consists of amino acid residues 23-508 of SEQ ID NO: 1215, amino acid residues 18-498 of SEQ ID NO: 1216, amino acid residues 23-508 of SEQ ID NO: 1218, or amino acid residues 18-498 of SEQ ID NO: 1219, or the amino acid sequence of the sALP includes or consists of amino acid residues 23-512 of SEQ ID NO: 1215, amino acid residues 18-502 of SEQ ID NO: 1216, amino acid residues 23-512 of SEQ ID NO: 1218, or amino acid residues 18-502 of SEQ ID NO: 1219. In some embodiments, the amino acid sequence of the sALP includes an amino acid sequence having at least 80%, 85%, 90%, 95%, or 99% sequence identity to SEQ ID NO: 1205. In some embodiments, the amino acid sequence of the sALP includes or consists of the amino acid sequence of SEQ ID NO: 1205.

In some embodiments, the amino acid sequence of the sALP includes or consists of amino acid residues 1-497, 1-498, 1-499, 1-500, 1-501, 1-502, 1-503, 1-504, 1-505, 1-506, 1-507, 1-508, 1-509, 1-510, 1-511, 1-512, 23-497, 23-498, 23-499, 23-500, 23-501, 23-502, 23-503, 23-504, 23-505, 23-506, 23-507, 23-508, 23-509, 23-510, 23-511, or 23-512 of SEQ ID NO: 1218, where X is any amino acid but is not an amino acid corresponding to a pathogenic mutation at that position of human TNALP, e.g., not an amino acid corresponding to a pathogenic mutation provided in Table 1. In some embodiments, the amino acid sequence of the sALP includes or consists of amino acid residues 18-497, 18-498, 18-499, 18-500, 18-501, 18-502, 18-503, 18-504, 18-505, 18-506, 18-507, 18-508, 18-509, 18-510, 18-511, or 18-512 of SEQ ID NO: 1219, where X is any amino acid but is not an amino acid corresponding to a pathogenic mutation at that position of human TNALP, e.g., not an amino acid corresponding to a pathogenic mutation provided in Table 1.

In some embodiments, the amino acid sequence of the sALP includes an amino acid sequence having at least 80%, 85%, 90%, 95%, or 99% sequence identity to SEQ ID NOs: 1218 or 1219, where X is any amino acid but is not an amino acid corresponding to a pathogenic mutation at that position of human TNALP, e.g., not an amino acid corresponding to a pathogenic mutation provided in Table 1. In some embodiments, the amino acid sequence of the sALP includes or consists of an amino acid sequence having at least 80%, 85%, 90%, 95%, or 99% sequence identity to amino acid residues 23-508 of SEQ ID NO: 1215, amino acid residues 18-498 of SEQ ID NO: 1216, amino acid residues 23-508 of SEQ ID NO: 1218, or amino acid residues 18-498 of SEQ ID NO: 1219, or the amino acid sequence of the sALP consists of an amino acid sequence having at least 80%, 85%, 90%, 95%, or 99% sequence identity to amino acid residues 23-512 of SEQ ID NO: 1215, amino acid residues 18-502 of SEQ ID NO: 1216, amino acid residues 23-512 of SEQ ID NO: 1218, or amino acid residues 18-502 of SEQ ID NO: 1219, where X in SEQ ID NO: 1218 or 1219 is any amino acid but is not an amino acid corresponding to a pathogenic mutation at that position of human TNALP, e.g., not an amino acid corresponding to a pathogenic mutation provided in Table 1.

In some embodiments, A and/or B are absent.

In some embodiments, A and/or B includes a fragment crystallizable region (Fc). In some embodiments, the Fc includes a $C_{H2}$ domain, a $C_{H3}$ domain, and a hinge region, or the Fc is a constant domain of an immunoglobulin selected from the group consisting of IgG-1, IgG-2, IgG-3, and IgG-4, e.g., IgG-1. In some embodiments, the amino acid sequence of the Fc includes an amino acid sequence having at least 80%, 85%, 90%, 95%, or 99% sequence identity to SEQ ID NO: 401. In some embodiments, the amino acid sequence of the Fc includes or consists of the amino acid sequence of SEQ ID NO: 401.

In some embodiments, A and/or B includes $I_n$, where I represents an aspartic acid or a glutamic acid and n=10 to 16, e.g., n is 10, 11, 12, 13, 14, 15, or 16. In some embodiments, the $I_n$ is $E_{10}$, $E_{11}$, $E_{12}$, $E_{13}$, $E_{14}$, $E_{15}$, $E_{16}$, $D_{10}$, $D_{11}$, $D_{12}$, $D_{13}$, $D_{14}$, $D_{15}$, or $D_{16}$, e.g., $E_{10}$ or $D_{10}$.

In some embodiments, A and/or B includes a bone-targeting moiety, e.g., including 6, 7, 8, 9, 10, 11, 12, 13, 14, 15, or 16 consecutive acidic residues, e.g., aspartic acid or glutamic acid. In some embodiments, the bone-targeting moiety includes or consists of $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$. In some embodiments, the polypeptide does not include a polyaspartic acid or polyglutamic acid region longer than three consecutive aspartic acid or glutamic acid residues, or the polypeptide does not include a polyaspartic acid or polyglutamic acid region longer than two consecutive aspartic acid or glutamic acid residues.

In some embodiments, the polypeptide does not include a bone-targeting moiety.

In some embodiments, the polypeptide includes the structure C-sALP-D-Fc-E or the structure C-Fc-D-sALP-E, where C is absent or is an amino acid sequence of at least one amino acid, D is absent or is an amino acid sequence of at least one amino acid, and E is absent or is an amino acid sequence of at least one amino acid.

In some embodiments, C and/or E are absent. In some embodiments, D is two amino acid residues, e.g., leucine-lysine or aspartic acid-isoleucine. In some embodiments, D is any linker described herein, e.g., the amino acid sequence of any one of SEQ ID NOs: 301-391.

In some embodiments, the polypeptide includes the structure C-sALP-D-Fc-G-$I_n$-H or the structure C-Fc-D-sALP-G-$I_n$-H, where C is absent or is an amino acid sequence of at least one amino acid, D is absent or is an amino acid sequence of at least one amino acid, G is absent or is an amino acid sequence of at least one amino acid, H is absent or is an amino acid sequence of at least one amino acid, I represents an aspartic acid or a glutamic acid, and n=10 to 16, e.g., n is 10, 11, 12, 13, 14, 15, or 16. In some embodiments, the $I_n$ is $E_{10}$, $E_{11}$, $E_{12}$, $E_{13}$, $E_{14}$, $E_{15}$, $E_{16}$, $D_{10}$, $D_{11}$, $D_{12}$, $D_{13}$, $D_{14}$, $D_{15}$, or $D_{16}$, e.g., $E_{10}$ or $D_{10}$.

In some embodiments, C and/or H are absent. In some embodiments, G is two amino acid residues, e.g., leucine-lysine or aspartic acid-isoleucine, e.g., aspartic acid-isoleucine. In some embodiments, I is an aspartic acid or a glutamic acid and n=10 to 16, e.g., n is 10, 11, 12, 13, 14, 15, or 16, e.g., I is aspartic acid and n=10. In some embodiments, D is two amino acid residues, e.g., leucine-lysine or aspartic acid-isoleucine, e.g., leucine-lysine. In some embodiments, D or G is any linker described herein, e.g., the amino acid sequence of any one of SEQ ID NOs: 301-391.

In some embodiments, the amino acid sequence of the polypeptide includes an amino acid sequence having at least 80%, 85%, 90%, 95%, or 99% sequence identity of any one of SEQ ID NOs: 1201, 1204, 1220, or 1221, e.g., SEQ ID NO: 1204. In some embodiments, the amino acid sequence of the polypeptide includes or consists of the amino acid sequence of any one of SEQ ID NOs: 1201, 1204, 1220, or 1221, e.g., SEQ ID NO: 1204. In some embodiments, the amino acid sequence of the polypeptide consists of the amino acid sequence of SEQ ID NO: 1204.

In a second aspect, the invention features a method of treating a neurocutaneous syndrome in a subject, the method including administering to the subject a therapeutically effective amount of a pharmaceutical composition including: (a) a polypeptide including the structure V-NP-W; and (b) a pharmaceutically acceptable excipient, where NP is a natriuretic peptide that is an agonist of natriuretic peptide receptor B (NPR-B), V is absent or is an amino acid sequence of at least one amino acid, and W is absent or is an amino acid sequence of at least one amino acid. In some embodiments, the syndrome in the subject is thereby treated.

In some embodiments, the NP includes the structure: [N-terminal extension]-[short segment]-[ring domain]-[C-terminal extension], where the ring domain includes the amino acid sequence of SEQ ID NO: 6, amino acid residues 11-27 of SEQ ID NO: 30, or SEQ ID NO: 95, and each of the N-terminal extension, short segment, and C-terminal extension is, independently, absent or is an amino acid sequence of at least one amino acid. In some embodiments, the ring domain includes amino acid residues 6-22 of SEQ ID NO: 126. In some embodiments, the amino acid at position 17 of SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Val, Ala, Ser, Glu, Arg, Tyr, Cys, Pro, or Asp, e.g., Phe, Leu, Ile, Thr, Val, Ala, or Ser, e.g., Phe or Leu, e.g., Phe, e.g., Leu. In some embodiments, the ring domain includes the amino acid sequence of SEQ ID NO: 12. In some embodiments, the short segment and the ring domain together include the amino acid sequence of any one of SEQ ID NOs: 4, 13-30, 119-122, 126, or 156-161, e.g., SEQ ID NOs: 4 or 13-30. In some embodiments, the amino acid sequence of the short segment includes or consists of amino acid residues 1-5, 2-5, 3-5, 4-5, or 5, e.g., consists of amino acid residues 1-5, of SEQ ID NO: 4; amino acid residues 1-10 of SEQ ID NO: 17; amino acid residues 1-5 of SEQ ID NO: 19; amino acid residues 1-3 of SEQ ID NO: 20; amino acid residues 1-5 of SEQ ID NO: 21; or amino acid residues 1-6 of SEQ ID NO: 29. In some embodiments, the amino acid sequence of the short segment and the ring domain together includes or consists of the amino acid sequence of SEQ ID NO: 4. In some embodiments, the amino acid sequence of the short segment and the ring domain together includes or consists of the amino acid sequence of any one of SEQ ID NOs: 119-122, 126, or 156-161 (e.g., where X in SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe, Leu, Ile, Thr, Val, Ala, or Ser, e.g., Phe or Leu, e.g., Phe, e.g., Leu).

In some embodiments, the amino acid sequence of the N-terminal extension includes amino acid residues 1-31 or 17-31 of SEQ ID NO: 11. In some embodiments, the amino acid sequence of the N-terminal extension includes amino acid residues 17-31 of SEQ ID NO: 11. In some embodiments, the amino acid sequence of the N-terminal extension includes KGANKK (SEQ ID NO: 314) or KGANQK (SEQ ID NO: 315). In some embodiments, the N-terminal extension, short segment, and ring domain together include the amino acid sequence of SEQ ID NO: 11. In some embodiments, the C-terminal extension includes the amino acid sequence of SEQ ID NOs: 117 or 118 or includes amino acid residues 23-37 selected from any one of SEQ ID NOs: 101-116. In some embodiments, the amino acid sequence of the NP consists of SEQ ID NOs: 4 or 11, or the amino acid sequence of any one of SEQ ID NOs: 31-94, or a fragment thereof including at least a ring domain, or the amino acid sequence of any one of SEQ ID NOs: 13-29, 100-116, 119-125, 127-233, or 1001-1155.

In any of the aspects described herein, the amino acid sequence of the NP may include amino acids 6-22 of SEQ ID NO: 126, and the amino acid at position 17 of SEQ ID NO: 126 may be Phe.

In any of the aspects described herein, the amino acid sequence of the NP may include amino acids 6-22 of SEQ ID NO: 126, and the amino acid at position 17 of SEQ ID NO: 126 may be Leu.

In any of the aspects described herein, the amino acid sequence of the NP may include amino acids 6-22 of SEQ ID NO: 126, and the amino acid at position 17 of SEQ ID NO: 126 may be Ile.

In any of the aspects described herein, the amino acid sequence of the NP may include amino acids 6-22 of SEQ ID NO: 126, and the amino acid at position 17 of SEQ ID NO: 126 may be Thr.

In any of the aspects described herein, the amino acid sequence of the NP may include amino acids 6-22 of SEQ ID NO: 126, and the amino acid at position 17 of SEQ ID NO: 126 may be Glu.

In any of the aspects described herein, the amino acid sequence of the NP may include amino acids 6-22 of SEQ ID NO: 126, and the amino acid at position 17 of SEQ ID NO: 126 may be Arg.

In any of the aspects described herein, the amino acid sequence of the NP may include amino acids 6-22 of SEQ ID NO: 126, and the amino acid at position 17 of SEQ ID NO: 126 may be Tyr.

In any of the aspects described herein, the amino acid sequence of the NP may include amino acids 6-22 of SEQ ID NO: 126, and the amino acid at position 17 of SEQ ID NO: 126 may be Cys.

In any of the aspects described herein, the amino acid sequence of the NP may include amino acids 6-22 of SEQ ID NO: 126, and the amino acid at position 17 of SEQ ID NO: 126 may be Pro.

In any of the aspects described herein, the amino acid sequence of the NP may include amino acids 6-22 of SEQ ID NO: 126, and the amino acid at position 17 of SEQ ID NO: 126 may be Asp.

In any of the aspects described herein, the amino acid sequence of the NP may include amino acids 6-22 of SEQ ID NO: 126, and the amino acid at position 17 of SEQ ID NO: 126 may be Gly.

In any of the aspects described herein, the amino acid sequence of the NP may include amino acids 6-22 of SEQ ID NO: 126, and the amino acid at position 17 of SEQ ID NO: 126 may be Ala.

In any of the aspects described herein, the amino acid sequence of the NP may include amino acids 6-22 of SEQ ID NO: 126, and the amino acid at position 17 of SEQ ID NO: 126 may be Ser.

In any of the aspects described herein, the amino acid sequence of the NP may include amino acids 6-22 of SEQ ID NO: 126, and the amino acid at position 17 of SEQ ID NO: 126 may be Val.

In any of the aspects described herein, the amino acid sequence of the NP may include amino acids 6-22 of SEQ ID NO: 126, and the amino acid at position 17 of SEQ ID NO: 126 may be Trp.

In any of the aspects described herein, the amino acid sequence of the NP may include amino acids 6-22 of SEQ ID NO: 126, and the amino acid at position 17 of SEQ ID NO: 126 may be Asn.

In any of the aspects described herein, the amino acid sequence of the NP may include amino acids 6-22 of SEQ ID NO: 126, and the amino acid at position 17 of SEQ ID NO: 126 may be Gln.

In any of the aspects described herein, the amino acid sequence of the NP may include amino acids 6-22 of SEQ ID NO: 126, and the amino acid at position 17 of SEQ ID NO: 126 may be His.

In any of the aspects described herein, the amino acid sequence of the NP may include amino acids 6-22 of SEQ ID NO: 126, and the amino acid at position 17 of SEQ ID NO: 126 may be Lys.

In some embodiments, V and/or W are absent.

In some embodiments, V and/or W includes a fragment crystallizable region (Fc). In some embodiments, the Fc includes a $C_{H2}$ domain, a $C_{H3}$ domain, and a hinge region, or the Fc is a constant domain of an immunoglobulin selected from the group consisting of IgG-1, IgG-2, IgG-3, and IgG-4, e.g., IgG-1. In some embodiments, the amino acid sequence of the Fc includes an amino acid sequence having at least 80%, 85%, 90%, 95%, or 99% sequence identity to SEQ ID NO: 401. In some embodiments, the amino acid sequence of the Fc includes or consists of the amino acid sequence of SEQ ID NO: 401.

In some embodiments, V and/or W includes a glycine-rich region.

In some embodiments, the amino acid sequence of V or W consists of one or more glycines and one or more serines. In some embodiments, the amino acid sequence of V or W includes $[(Gly)_m(Ser)]_n(Gly)_p$ or $(Gly)_p[(Ser)(Gly)_m]_n$, where each of m, n, and p is, independently, between 0 and 20. In some embodiments, m is between 1 and 6; n is between 1 and 10; and p is between 0 and 4, e.g., m is 4 and n is 1-6. In some embodiments, combinations of m, n, and p are selected from a single row of Table 2, or the amino acid sequence of V or W includes the amino acid sequence of any one of SEQ ID NOs: 301-391.

In some embodiments, V and/or W does not include a bone-targeting moiety.

In some embodiments, V and/or W includes a bone-targeting moiety, e.g., including 6, 7, 8, 9, 10, 11, 12, 13, 14, 15, or 16 consecutive acidic residues, e.g., aspartic acid or glutamic acid. In some embodiments, the bone-targeting moiety includes or consists of $E_6$, $E_7$, $E_g$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments, V and/or W includes a cathepsin (e.g., cathepsin K) cleavage sequence. In some embodiments, the cathepsin cleavage sequence is HGPQG (SEQ ID NO: 374) or HKLRG (SEQ ID NO: 375).

In some embodiments, the polypeptide includes the structure V-NP-W, where NP is a natriuretic peptide that is an agonist of natriuretic peptide receptor B (NPR-B), each of V and W is, independently, absent or is an amino acid sequence of at least one amino acid, and the NP includes the amino acid sequence of any one of SEQ ID NOs: 17-29, 31-40, 42-94, 101-116, 119-122, 128-161, or 163-233, or V or W includes the amino acid sequence of any one of SEQ ID NOs: 304-313, 322-333, or 337-391.

In some embodiments, the polypeptide includes the structure V-NP or NP-W, where NP is the natriuretic peptide that is an agonist of natriuretic peptide receptor B (NPR-B), and each of V and W includes, independently, the amino acid sequence of any one of SEQ ID NOs: 304-313, 322-333, or 337-391.

In some embodiments, the polypeptide includes the structure X-Fc-Y-NP-Z or the structure X-NP-Y-Fc-Z, where NP is the natriuretic peptide that is an agonist of natriuretic peptide receptor B (NPR-B) (e.g., any NP described herein), and each of X, Y, and Z is, independently, absent or is an amino acid sequence of at least one amino acid. In some embodiments, Y includes a glycine-rich region. In some embodiments, the amino acid sequence of Y consists of one or more glycines and one or more serines. In some embodiments, the amino acid sequence of Y includes $[(Gly)_m(Ser)]_n(Gly)_p$ or $(Gly)_p[(Ser)(Gly)_m]_n$, where each of m, n, and p is, independently, between 0 and 20. In some embodiments, m is between 1 and 6; n is between 1 and 10; and p is between 0 and 4, e.g., m is 4 and n is 1-6. In some embodiments, combinations of m, n, and p are selected from a single row of Table 2, or the amino acid sequence of Y includes the amino acid sequence of any one of SEQ ID NOs: 301-389. In some embodiments, the amino acid sequence of Y consists of $[(Gly)_m(Ser)]_n(Gly)_p$ or $(Gly)_p[(Ser)(Gly)_m]_n$, wherein combinations of m, n, and p are selected from a single row of Table 2, or the amino acid sequence of Y consists of the amino acid sequence of any one of SEQ ID NOs: 301-389. In some embodiments, X is absent, Z is absent, or X and Z are both absent. In some embodiments, X, Y, or Z includes a bone-targeting moiety, e.g., including 6, 7, 8, 9, 10, 11, 12, 13, 14, 15, or 16 consecutive acidic residues, e.g., aspartic acid or glutamic acid. In some embodiments, the bone-targeting moiety includes or consists of $E_6$, $E_7$, $E_g$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments, X, Y, or Z includes a cathepsin (e.g., cathepsin K) cleavage sequence. In some embodiments, the cathepsin cleavage sequence includes or consists of HGPQG (SEQ ID NO: 374) or HKLRG (SEQ ID NO: 375).

In some embodiments, the amino acid of the polypeptide includes or consists of the amino acid sequence of any one of SEQ ID NOs: 501-608, e.g., SEQ ID NOs: 502, 504, 506, 512, 514, 516, 530, 560, 562, 564, 572, 574, 576, 584, 586, 588, 596, 598, 600, or 608, e.g., SEQ ID NOs: 504, 512, 530, 554, 572, or 578, e.g., SEQ ID NO: 512. In some embodiments, the amino acid of the polypeptide includes a bone-targeting moiety, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments, the amino acid sequence of the polypeptide includes an amino acid sequence having at least 80%, 85%, 90%, 95%, or 99% sequence identity to any one of SEQ ID NOs: 504, 512, 530, 554, 572, or 578, e.g., SEQ ID NOs: 504, 512, 530, or 572, e.g., SEQ ID NO: 512. In some embodiments, the amino acid sequence of the polypeptide includes or consists of the amino acid sequence of any one of SEQ ID NOs: 504, 512, 530, 554, 572, or 578, e.g., SEQ ID NOs: 504, 512, 530, or 572, e.g., SEQ ID NO: 512. In some embodiments, the amino acid sequence of the polypeptide consists of the amino acid sequence of SEQ ID NOs: 504, 512, 530, or 572, e.g., SEQ ID NO: 512.

In some embodiments, the polypeptide includes the structure X-Fc-Y-NP-Z or the structure X-NP-Y-Fc-Z, wherein NP is a natriuretic peptide that is an agonist of natriuretic peptide receptor B (NPR-B), and wherein either: (i) NP includes amino acids 6-22 of SEQ ID NO: 126, wherein the amino acid at position 17 is not Met; and each of X, Y, and Z is, independently, absent or is an amino acid sequence of at least one amino acid; or (ii) each of X and Z is, independently, absent or is an amino acid sequence of at least one amino acid; and the amino acid sequence of Y includes $[(Gly)_4(Ser)]_n(Gly)_p$ or $(Gly)_p[(Ser)(Gly)_4]_n$, wherein n is between 1 and 10 and p is between 0 and 4 or wherein combinations of m, n, and p are selected from a single row of Table 2, or wherein the amino acid sequence of Y includes the amino acid sequence of any one of SEQ ID NOs: 304-313, 322-333, or 337-391.

In some embodiments, the polypeptide includes the structure X-Fc-Y-NP-Z.

In some embodiments, (i) NP includes amino acids 6-22 of SEQ ID NO: 126, wherein the amino acid at position 17 is not Met; and each of X, Y, and Z is, independently, absent or is an amino acid sequence of at least one amino acid. In some embodiments, the amino acid at position 17 of SEQ ID NO: 126 is Phe, Leu, Ile, Thr, Val, Ala, or Ser. In some embodiments, the amino acid at position 17 of SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu. In some embodiments, the NP includes the structure: [N-terminal extension]-[short segment]-[ring domain]-[C-terminal extension], wherein said ring domain comprises amino acids 6-22 of SEQ ID NO: 126, wherein the amino acid at position 17 is not Met, and each of said N-terminal extension, short segment, and C-terminal extension is, independently, absent or is an amino acid sequence of at least one amino acid. In some embodiments, the amino acid sequence of said NP includes or consists of the amino acid sequence of any one of SEQ ID NOs: 119-125 or 156-220, wherein position 17 relative to SEQ ID NO: 126 is not Met, or the amino acid sequence of any one of SEQ ID NOs: 221-233.

In some embodiments, (ii) each of X and Z is, independently, absent or is an amino acid sequence of at least one amino acid; and the amino acid sequence of Y comprises $[(Gly)_4(Ser)]_n(Gly)_p$ or $(Gly)_p[(Ser)(Gly)_4]_n$, wherein n is between 1 and 10 and p is between 0 and 4, or wherein the amino acid sequence of Y comprises the amino acid sequence of any one of SEQ ID NOs: 304-313, 322-333, or 337-391. In some embodiments, the NP includes the structure: [N-terminal extension]-[short segment]-[ring domain]-[C-terminal extension], wherein the ring domain includes the amino acid sequence of SEQ ID NO: 6, amino acids 11-27 of SEQ ID NO: 30, or SEQ ID NO: 95, and each of the N-terminal extension, short segment, and C-terminal extension is, independently, absent or is an amino acid sequence of at least one amino acid. In some embodiments, the ring domain includes amino acids 6-22 of SEQ ID NO: 126. In some embodiments, the amino acid at position 17 of SEQ ID NO: 126 is Phe, Leu, Ile, Thr, Val, Ala, or Ser. In some embodiments, the amino acid at position 17 of SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu. In some embodiments, the ring domain includes the amino acid sequence of SEQ ID NO: 12. In some embodiments, the short segment and the ring domain together include the amino acid sequence of any one of SEQ ID NOs: 4 or 13-30. In some embodiments, the amino acid sequence of the short segment and the ring domain together consists of the amino acid sequence of SEQ ID NO: 4. In some embodiments, the amino acid sequence of the short segment and the ring domain together consists of the amino acid sequence of any one of SEQ ID NOs: 119-122, 126, or 156-161 (e.g., where X in SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu). In some embodiments, the N-terminal extension, short segment, and ring domain together include the amino acid sequence of SEQ ID NO: 11. In some embodiments, the amino acid sequence of the NP consists of SEQ ID NO: 4. In some embodiments, the amino acid sequence of the NP consists of SEQ ID NO: 11. In some embodiments, the amino acid sequence of the NP consists of the amino acid sequence of any one of SEQ ID NOs: 31-94, or a fragment thereof including at least a ring domain. In some embodiments, the amino acid sequence of the NP includes or consists of the amino acid sequence of any one of SEQ ID NOs: 13-29, 100-116, 119-125, 127-233, or 1001-1155.

In some embodiments, the amino acid sequence of the short segment consists of amino acids 1-5 of SEQ ID NO: 4. In some embodiments, the amino acid sequence of the short segment consists of amino acids 1-5, 2-5, 3-5, 4-5, or 5 of SEQ ID NO: 4, amino acids 1-10 of SEQ ID NO: 17, amino acids 1-5 of SEQ ID NO: 19, amino acids 1-3 of SEQ ID NO: 20, amino acids 1-5 of SEQ ID NO: 21, or amino acids 1-6 of SEQ ID NO: 29. In some embodiments, the amino acid sequence of the N-terminal extension includes amino acids 1-31 of SEQ ID NO: 11. In some embodiments, the amino acid sequence of the N-terminal extension includes amino acids 17-31 of SEQ ID NO: 11. In some embodiments, the amino acid sequence of the N-terminal extension includes KGANKK (SEQ ID NO: 314) or KGANQK (SEQ ID NO: 315). In some embodiments, the C-terminal extension includes the amino acid sequence of SEQ ID NO: 118, SEQ ID NO: 117, or amino acids 23-37 selected from any one of SEQ ID NOs: 101-116.

In some embodiments, the NP is selective for NPR-B over NPR-A, wherein the $EC_{50(NPR-A)}/EC_{50(NPR-B)}$ ratio for the NP, as determined in an in vivo pharmacokinetic assay, is at least 30.

In some embodiments, the Fc includes a $C_{H2}$ domain, a $C_{H3}$ domain, and a hinge region. In some embodiments, the Fc is a constant domain of an immunoglobulin selected from the group consisting of IgG-1, IgG-2, IgG-3, IgG-3 and IgG-4. In some embodiments, the Fc includes the amino acid sequence of SEQ ID NO: 401. In some embodiments, the immunoglobulin is IgG-1. In some embodiments, the amino acid sequence of the Fc includes an amino acid sequence having at least 80%, 85%, 90%, 95%, or 99% sequence identity to SEQ ID NO: 401, or includes or consists of the amino acid sequence of SEQ ID NO: 401.

In some embodiments, Y includes a glycine-rich region, or the amino acid sequence of Y consists of one or more glycines and one or more serines. For example, the amino acid sequence of Y may include $[(Gly)_m(Ser)]_n(Gly)_p$ or $(Gly)_p[(Ser)(Gly)_m]_n$, wherein each of m, n, and p is, independently, between 0 and 20. In some embodiments, m is 0-20 (e.g., m is 3-6, 3-7, 3-8, 3-9, 3-10, 3-11, 3-12, 3-14, 3-15, 3-16, 3-17, 3-18, 3-19, 3-20, 4-6, 4-7, 4-8, 4-9, 4-10, 4-11, 4-12, 4-14, 4-15, 4-16, 4-17, 4-18, 4-19, 4-20, 5-6, 5-7, 5-8, 5-9, 5-10, 5-11, 5-12, 5-14, 5-15, 5-16, 5-17, 5-18, 5-19, 5-20, 6-7, 6-8, 6-9, 6-10, 6-11, 6-12, 6-14, 6-15, 6-16, 6-17, 6-18, 6-19, 6-20, 7-8, 7-9, 7-10, 7-11, 7-12, 7-14, 7-15, 7-16, 7-17, 7-18, 7-19, 7-20, 8-9, 8-10, 8-11, 8-12, 8-14, 8-15, 8-16, 8-17, 8-18, 8-19, 8-20, 9-10, 9-11, 9-12, 9-14, 9-15, 9-16, 9-17, 9-18, 9-19, 9-20, 10-11, 10-12, 10-14, 10-15, 10-16, 10-17, 10-18, 10-19, or 10-20). In some embodiments, m is 4 and n is 1-6. In some embodiments, combinations of m, n, and p are selected from a single row of Table 2, or the amino acid sequence of Y includes the amino acid sequence of any one of SEQ ID NOs: 304-313, 322-333, or 337-391. In some embodiments, the amino acid sequence of Y consists of $[(Gly)_m(Ser)]_n(Gly)_p$ or $(Gly)_p[(Ser)(Gly)_n]_n$, wherein combinations of m, n, and p are selected from a single row of Table 2, or the amino acid sequence of Y consists of the amino acid sequence of any one of SEQ ID NOs: 304-313, 322-333, or 337-391.

In some embodiments, X is absent, Z is absent, or X and Z are both absent.

In some embodiments, X, Y, or Z includes a bone-targeting moiety, e.g., including 6, 7, 8, 9, 10, 11, 12, 13, 14, 15, or 16 consecutive acidic residues, e.g., aspartic acid or glutamic acid. In some embodiments, the bone-targeting moiety includes or consists of $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments, X, Y, or Z includes a cathepsin (e.g., cathepsin K) cleavage sequence. In some embodiments, the cathepsin cleavage sequence includes or consists of HGPQG (SEQ ID NO: 374) or HKLRG (SEQ ID NO: 375).

In some embodiments, the polypeptide includes or consists of the amino acid sequence of any one of SEQ ID NOs: 501-608, e.g., SEQ ID NOs: 502, 504, 506, 512, 514, 516, 530, 560, 562, 564, 572, 574, 576, 584, 586, 588, 596, 598, 600, or 608. In some embodiments, the polypeptide includes a bone-targeting moiety, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments, the polypeptide includes or consists of the amino acid sequence of SEQ ID NO: 504.

In some embodiments, the polypeptide includes or consists of the amino acid sequence of SEQ ID NO: 512.

In some embodiments, the polypeptide includes or consists of the amino acid sequence of SEQ ID NO: 530.

In some embodiments, the polypeptide includes or consists of the amino acid sequence of SEQ ID NO: 554.

In some embodiments, the polypeptide includes or consists of the amino acid sequence of SEQ ID NO: 572.

In some embodiments, the polypeptide includes or consists of the amino acid sequence of SEQ ID NO: 578.

In some embodiments, the polypeptide includes or consists of the amino acid sequence of SEQ ID NO: 560.

In some embodiments, the polypeptide includes or consists of the amino acid sequence of SEQ ID NO: 566.

In some embodiments, the polypeptide includes or consists of the amino acid sequence of SEQ ID NO: 538 (e.g., where X in SEQ ID NO: 538 can be any amino acid, e.g., Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu).

In some embodiments, the polypeptide includes the structure V-NP.

In some embodiments, any of the NPs or polypeptides described herein may be used in conjunction with the method (e.g., NPs or polypeptides described in any of the aspects described herein). In some embodiments, the amino acid sequence of V or W includes $[(Gly)_m(Ser)]_n(Gly)_p$ or $(Gly)_p[(Ser)(Gly)_m]_n$, wherein each of m, n, and p is, independently, between 0 and 20. In some embodiments, m is 4 and n is 1-6. In some embodiments, V is absent, W is absent, or V and W are both absent. In some embodiments, V and/or W includes a bone-targeting moiety, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$. In some embodiments, V and/or W includes a cathepsin (e.g., cathepsin K) cleavage sequence, e.g., HGPQG (SEQ ID NO: 374) or HKLRG (SEQ ID NO: 375).

In some embodiments of any of the aspects described herein, the polypeptide of the invention, e.g., the sALP polypeptide and/or the NP polypeptide, is in dimeric form. In some embodiments, the polypeptide is glycosylated or pegylated.

In some embodiments of any of the aspects described herein, the pharmaceutical composition is administered in a dosage between about 0.2 mg/kg to about 20 mg/kg of the polypeptide of the invention, e.g., the sALP polypeptide and/or the NP polypeptide, e.g., the sALP polypeptide. In some embodiments, the pharmaceutical composition is administered to the subject in a dosage between about 0.2 mg/kg to about 20 mg/kg once, twice, three times, or four times daily. The dosage may be between, e.g., about 0.5 mg/kg to about 10 mg/kg, e.g., about 1 mg/kg to about 5 mg/kg, once, twice, three times, or four times daily. In some embodiments, the dosage is about 1 mg/kg, about 2 mg/kg, or about 3 mg/kg once, twice, or three times daily. In some embodiments, the pharmaceutical composition is administered to the subject in a dosage between about 0.2 mg/kg to about 20 mg/kg once, twice, three times, or four times weekly. The dosage may be between, e.g., about 0.5 mg/kg to about 10 mg/kg, e.g., about 1 mg/kg to about 5 mg/kg, once, twice, three times, or four times weekly. In some embodiments, the dosage is about 1 mg/kg, about 2 mg/kg, or about 3 mg/kg once, twice, or three times weekly.

In some embodiments of any of the aspects described herein, the pharmaceutical composition is administered in a dosage between about 0.5 mg/kg to about 500 mg/kg of the polypeptide of the invention, e.g., the sALP polypeptide and/or the NP polypeptide, e.g., the NP polypeptide. In some embodiments, the pharmaceutical composition is administered to the subject in a dosage between about 0.5 mg/kg to about 500 mg/kg once, twice, three times, or four times daily. The dosage may be between, e.g., about 5 mg/kg to about 200 mg/kg, e.g., about 10 mg/kg to about 100 mg/kg, once, twice, three times, or four times daily. In some embodiments, the dosage is about 10 mg/kg or about 100 mg/kg twice daily. In some embodiments, the pharmaceutical composition is administered to the subject in a dosage between about 0.5 mg/kg to about 500 mg/kg once, twice, three times, or four times weekly. The dosage may be between, e.g., about 5 mg/kg to about 200 mg/kg, e.g., about 10 mg/kg to about 100 mg/kg, e.g., about 20 mg/kg to about 40 mg/kg, once, twice, three times, or four times weekly. In some embodiments, the dosage is about 10 mg/kg, about 30 mg/kg, or about 100 mg/kg, once, twice, or three times weekly.

In some embodiments of any of the aspects described herein, the pharmaceutical composition is administered in a dosage between about 10 µg/kg to about 1,000 µg/kg of the polypeptide of the invention, e.g., the sALP polypeptide and/or the NP polypeptide, e.g., the NP polypeptide. In some embodiments, the pharmaceutical composition is administered to the subject in a dosage between about 10 µg/kg to about 1,000 µg/kg once, twice, three times, or four times weekly. The dosage may be between, e.g., about 20 µg/kg to about 800 µg/kg, e.g., about 30 µg/kg to about 600 µg/kg, e.g., about 50 µg/kg to about 500 µg/kg, e.g., about 100 µg/kg to about 400 µg/kg, e.g., about 200 µg/kg to about 300 µg/kg, once, twice, three times, or four times weekly. In some embodiments, the dosage is about 30 µg/kg, about 100 µg/kg, about 300 µg/kg, or about 500 µg/kg, once, twice, or three times weekly.

In some embodiments of any of the aspects described herein, the pharmaceutical composition is administered subcutaneously. In some embodiments, the pharmaceutical composition is administered one time, two times, or three times per week.

In a third aspect, the invention features a composition including a first polypeptide and a second polypeptide, where a) the first polypeptide includes the structure A-sALP-B, where i) sALP is the extracellular domain of an alkaline phosphatase, ii) A is absent or is an amino acid sequence of at least one amino acid, and iii) B is absent or is an amino acid sequence of at least one amino acid; and b) the second polypeptide includes the structure V-NP-W, where i) NP is a natriuretic peptide that is an agonist of natriuretic peptide receptor B (NPR-B), ii) V is absent or is an amino acid sequence of at least one amino acid, and iii) W is absent or is an amino acid sequence of at least one amino acid.

In some embodiments, the first polypeptide is any sALP polypeptide described herein, e.g., as described for the first aspect. In some embodiments, the amino acid sequence of the first polypeptide includes an amino acid sequence having at least 80%, 85%, 90%, 95%, or 99% sequence identity of any one of SEQ ID NOs: 1201, 1204, 1220, or 1221, e.g., SEQ ID NO: 1204. In some embodiments, the amino acid sequence of the first polypeptide includes or consists of the amino acid sequence of SEQ ID NO: 1204.

In some embodiments, the second polypeptide is any NP polypeptide described herein, e.g., as described for the second aspect. In some embodiments, the amino acid sequence of the second polypeptide includes an amino acid sequence having at least 80%, 85%, 90%, 95%, or 99% sequence identity to any one of SEQ ID NOs: 504, 512, 530, 554, 572, or 578, e.g., SEQ ID NO: 512. In some embodiments, the amino acid sequence of the second polypeptide includes or consists of the amino acid sequence of SEQ ID NO: 512.

In some embodiments, the amino acid sequence of the first polypeptide includes or consists of the amino acid sequence of SEQ ID NOs: 1204 or 1221, and the amino acid sequence of the second polypeptide includes or consists of the amino acid sequence of SEQ ID NOs: 504, 512, 530, or 572.

In some embodiments, the first polypeptide and/or the second polypeptide are in dimeric form. In some embodiments, the first polypeptide and/or the second polypeptide are glycosylated or pegylated.

In some embodiments, the composition is a pharmaceutical composition including a pharmaceutically acceptable excipient, e.g., saline. In some embodiments, the composition is lyophilized.

In some embodiments, the first polypeptide is present in a dosage between about 0.2 mg/kg to about 20 mg/kg and the second polypeptide is present in a dosage between about 0.5 mg/kg to about 500 mg/kg. In some embodiments, the first polypeptide is present in a dosage between about 0.2 mg/kg to about 20 mg/kg, e.g., about 0.5 mg/kg to about 10 mg/kg, e.g., about 1 mg/kg to about 5 mg/kg, for once daily, twice daily, three times daily, four times daily, once weekly, twice weekly, three times weekly, or four times weekly administration, e.g., about 1 mg/kg, about 2 mg/kg, or about 3 mg/kg for once daily, twice daily, four times daily, once weekly, twice weekly, or three times weekly administration; and the second polypeptide is present in a dosage between about 0.5 mg/kg to about 500 mg/kg, e.g., about 5 mg/kg to about 200 mg/kg, e.g., about 10 mg/kg to about 100 mg/kg, e.g., about 20 mg/kg to about 40 mg/kg, for once daily, twice daily, three times daily, four times daily, once weekly, twice weekly, three times weekly, or four times weekly administration, e.g., about 10 mg/kg, about 30 mg/kg, or about 100 mg/kg, for once daily, twice daily, three times daily, once weekly, twice weekly, or three times weekly administration.

In some embodiments, the amino acid sequence of the first polypeptide includes the amino acid sequence of SEQ ID NO: 1204 and the amino acid sequence of the second polypeptide includes the amino acid sequence of SEQ ID NO: 512.

In a fourth aspect, the invention features a method of treating a disease or a condition in a subject, the method including administering to the subject a therapeutically effective amount of a first polypeptide and a second polypeptide, where a) the first polypeptide includes the structure A-sALP-B, where i) sALP is the extracellular domain of an alkaline phosphatase, ii) A is absent or is an amino acid sequence of at least one amino acid, and iii) B is absent or is an amino acid sequence of at least one amino acid; and b) the second polypeptide includes the structure V-NP-W, where i) NP is a natriuretic peptide that is an agonist of natriuretic peptide receptor B (NPR-B), ii) V is absent or is an amino acid sequence of at least one amino acid, and iii) W is absent or is an amino acid sequence of at least one amino acid; and the disease or the condition is selected from the group consisting of a neurocutaneous syndrome, a disorder associated with overactivation of FGFR3, a bone or cartilage disorder, a vascular smooth muscle disorder, and a condition for elongation of bone. In some embodiments, the disease or the condition in the subject is thereby treated.

In some embodiments, the first polypeptide is any polypeptide described herein including sALP, e.g., any sALP polypeptide described herein, e.g., as described for the first or third aspect. In some embodiments, the amino acid sequence of the first polypeptide includes an amino acid sequence having at least 80%, 85%, 90%, 95%, or 99% sequence identity of any one of SEQ ID NOs: 1201, 1204, 1220, or 1221, e.g., SEQ ID NO: 1204. In some embodiments, the amino acid sequence of the first polypeptide includes or consists of the amino acid sequence of SEQ ID NO: 1204.

In some embodiments, the second polypeptide is any polypeptide described herein including NP, e.g., any NP polypeptide described herein, e.g., as described for the second or third aspect. In some embodiments, the amino acid sequence of the second polypeptide includes an amino acid sequence having at least 80%, 85%, 90%, 95%, or 99% sequence identity to any one of SEQ ID NOs: 504, 512, 530, 554, 572, or 578, e.g., SEQ ID NO: 512. In some embodiments, the amino acid sequence of the second polypeptide includes or consists of the amino acid sequence of SEQ ID NO: 512.

In some embodiments, the first polypeptide and the second polypeptide are administered within ten days, five days, or twenty-four hours of each other, e.g., within ten, nine, eight, seven, six, five, four, three, or two days of each other or within twenty-four, twelve, eleven, ten, nine, eight, seven, six, five, four, three, two, or one hour(s) of each other.

In some embodiments, the first polypeptide and the second polypeptide are administered simultaneously. In some embodiments, the first polypeptide and the second polypeptide are formulated together in a composition or each separately in a composition. In some embodiments, the composition is a pharmaceutical composition comprising a pharmaceutically acceptable excipient, e.g., saline. In some embodiments, the composition is lyophilized. In some embodiments, the composition is any composition, e.g., a pharmaceutical composition, described herein, e.g., as described for the first, second, or third aspect.

In a fifth aspect, the invention features a kit including: a) a first polypeptide including the structure A-sALP-B, where i) sALP is the extracellular domain of an alkaline phosphatase, ii) A is absent or is an amino acid sequence of at least one amino acid, and iii) B is absent or is an amino acid sequence of at least one amino acid; and b) instructions for administering the first polypeptide to a patient diagnosed with or at risk of developing a neurocutaneous syndrome. In some embodiments, the first polypeptide is any polypeptide described herein including sALP, e.g., any sALP polypeptide described herein, e.g., as described in any of the above aspects.

In some embodiments, the kit further includes (c) a second polypeptide including the structure V-NP-W, where i) NP is a natriuretic peptide that is an agonist of natriuretic peptide receptor B (NPR-B), ii) V is absent or is an amino acid sequence of at least one amino acid, and iii) W is absent or is an amino acid sequence of at least one amino acid. In some embodiments, the second polypeptide is any polypeptide described herein including NP, e.g., any NP polypeptide described herein, e.g., as described in any of the above aspects.

In a sixth aspect, the invention features a kit including: a) a polypeptide including the structure V-NP-W, where i) NP is a natriuretic peptide that is an agonist of natriuretic peptide receptor B (NPR-B), ii) V is absent or is an amino acid sequence of at least one amino acid, and iii) W is absent or is an amino acid sequence of at least one amino acid; and b) instructions for administering the polypeptide to a patient diagnosed with or at risk of developing a neurocutaneous syndrome. In some embodiments, the polypeptide is any polypeptide described herein including NP, e.g., any NP polypeptide described herein, e.g., as described in any of the above aspects.

In a seventh aspect, the invention features a kit including: a) a first polypeptide including the structure A-sALP-B, where i) sALP is the extracellular domain of an alkaline phosphatase, ii) A is absent or is an amino acid sequence of at least one amino acid, and iii) B is absent or is an amino acid sequence of at least one amino acid; and b) a second polypeptide including the structure V-NP-W, where i) NP is a natriuretic peptide that is an agonist of natriuretic peptide receptor B (NPR-B), ii) V is absent or is an amino acid sequence of at least one amino acid, and iii) W is absent or is an amino acid sequence of at least one amino acid. In some embodiments, the first polypeptide is any polypeptide described herein including sALP, e.g., any sALP polypeptide described herein, e.g., as described in any of the above aspects; and the second polypeptide is any polypeptide described herein including NP, e.g., any NP polypeptide described herein, e.g., as described in any of the above aspects. In some embodiments, the first polypeptide and the second polypeptide are formulated together. In some embodiments, the first polypeptide and the second polypeptide are formulated separately and in individual dosage amount.

In any of the aspects described herein, the amino acid sequence of the sALP includes an amino acid sequence having at least 80%, 85%, 90%, 95%, or 99% sequence identity to any one of SEQ ID NOs: 1202, 1205, 1218, or 1219.

In any of the aspects described herein, the amino acid sequence of the sALP includes or consists of an amino acid sequence having at least 80%, 85%, 90%, 95%, or 99% sequence identity to amino acid residues 23-508 of SEQ ID NO: 1215, amino acid residues 18-498 of SEQ ID NO: 1216, amino acid residues 23-508 of SEQ ID NO: 1218, amino acid residues 18-498 of SEQ ID NO: 1219, amino acid residues 23-512 of SEQ ID NO: 1215, amino acid residues 18-502 of SEQ ID NO: 1216, amino acid residues 23-512 of SEQ ID NO: 1218, or amino acid residues 18-502 of SEQ ID NO: 1219, where X in SEQ ID NO: 1218 or 1219 is any amino acid but is not an amino acid corresponding to a pathogenic mutation at that position of human TNALP, e.g., not an amino acid corresponding to a pathogenic mutation provided in Table 1.

In any of the aspects described herein, the amino acid sequence of the NP includes or consists of amino acid residues 6-22 of SEQ ID NO: 126, and the amino acid at position 17 of SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Val, Ala, Ser, Glu, Arg, Tyr, Cys, Pro, or Asp, e.g., Phe, Leu, Ile, Thr, Val, Ala, or Ser, e.g., e.g., Phe, Leu, Arg, Tyr, e.g., Phe or Leu, e.g., Phe, e.g., Leu.

In any of the aspects described herein, the amino acid sequence of the NP comprises of consists of the amino acid sequence of any one of SEQ ID NOs: 13-29, 100-116, 119-125, 127-233, or 1001-1155.

In any of the aspects described herein, the NP is selective for NPR-B over NPR-A, where the $EC_{50(NPR-A)}/EC_{50(NPR-B)}$ ratio for the NP, as determined in an in vivo pharmacokinetic assay, is at least 30, e.g., at least 35, 40, 35, 50, 55, or 60.

In any of the aspects described herein, the Fc includes a $C_{H2}$ domain, a $C_{H3}$ domain, and a hinge region, or where the Fc is a constant domain of an immunoglobulin selected from the group consisting of IgG-1, IgG-2, IgG-3, and IgG-4, e.g., IgG-1. In some embodiments, the amino acid sequence of the Fc includes an amino acid sequence having at least 80%, 85%, 90%, 95%, or 99% sequence identity to SEQ ID NO: 401. In some embodiments, the amino acid sequence of the Fc includes or consists of SEQ ID NO: 401.

In any of the aspects described herein, the amino acids sequence of D or Y includes a glycine-rich region, or the amino acid sequence of D or Y consists of one or more glycines and one or more serines. For example, the amino acid sequence of D or Y may include or consist of $[(Gly)_m(Ser)]_n(Gly)_p$ or $(Gly)_p[(Ser)(Gly)_m]_n$, where each of m, n, and p is, independently, between 0 and 20. In some embodiments, m is between 1 and 6; n is between 1 and 10; and p is between 0 and 4, e.g., m is 4 and n is 1-6. In some embodiments, combinations of m, n, and p are selected from a single row of Table 2, or the amino acid sequence of D or Y includes or consists of the amino acid sequence of any one of SEQ ID NOs: 301-391.

In any of the aspects described herein, the amino acids sequence of D, G, or Y is optionally two amino acid residues (e.g., leucine-lysine or aspartic acid-isoleucine). In some embodiments of an sALP polypeptide, C and E may both be absent, and D may be absent or may be an amino acid sequence of at least one amino acid. For example, the polypeptide may consist of the structure sALP-D-Fc or the structure Fc-D-sALP, where D may be any linker described herein or may optionally consist of two amino acid residues, e.g., leucine-lysine. For example, the polypeptide may consist of the structure sALP-D-Fc. Optionally, the amino acid sequence of sALP is the amino acid sequence of SEQ ID NO: 1205, the amino acid sequence of D is leucine-lysine, and/or the amino acid sequence of Fc is the amino acid sequence of SEQ ID NO: 401. In other embodiments of an sALP polypeptide, C may be absent, and D and E may both be absent or may be an amino acid sequence of at least one amino acid. For example, the polypeptide may include the structure sALP-D-Fc-E or the structure Fc-D-sALP-E. In other embodiments of an sALP polypeptide, C may be absent, and D, G, and H may all be absent or may be an amino acid sequence of at least one amino acid. For example, the polypeptide may include the structure sALP-D-Fc-G-$I_n$-H. In some embodiments of an NP polypeptide, X and Z may both be absent, and Y may be absent or may be an amino acid sequence of at least one amino acid. For example, the polypeptide may consist of the structure NP-Y-Fc or the structure Fc-Y-NP, where Y may be any linker described herein or may optionally consist of two amino acid residues, e.g., leucine-lysine. For example, the polypeptide may consist of the structure NP-Y-Fc.

In any of the aspects described herein, one or more of A, B, C, D, E, G, H, V, W, X, Y, or Z are absent. In some embodiments, A is absent, B is absent, or A and B are both absent. In some embodiments, C is absent, E is absent, or C and E are both absent. In some embodiments, C is absent, H is absent, or C and H are both absent. In some embodiments, X is absent, Z is absent, or X and Z are both absent.

In any of the aspects described herein, the polypeptide of the invention, e.g., the sALP polypeptide and/or the NP polypeptide, may include a bone-targeting moiety, e.g., including 6, 7, 8, 9, 10, 11, 12, 13, 14, 15, or 16 consecutive acidic residues, e.g., aspartic acid or glutamic acid, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$. In some embodiments of any of the above aspects, one or more of A, B, C, D, E, V, W, X, Y, or Z includes a bone-targeting moiety, e.g., including 6, 7, 8, 9, 10, 11, 12, 13, 14, 15, or 16 consecutive acidic residues, e.g., aspartic acid or glutamic acid, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In any of the aspects described herein, the polypeptide of the invention optionally does not include a bone-targeting moiety (e.g., a polyaspartic acid or polyglutamic acid region longer than two consecutive aspartic acid or glutamic acid residues).

In any of the aspects described herein, the polypeptide of the invention may include a cathepsin (e.g., cathepsin K) cleavage sequence, e.g., HGPQG (SEQ ID NO: 374) or HKLRG (SEQ ID NO: 375). In some embodiments of any of the above aspects, A, B, C, D, E, G, H, V, W, X, Y, or Z includes a cathepsin (e.g., cathepsin K) cleavage sequence.

In some embodiments of any of the above aspects, the polypeptide of the invention may include a polypeptide having reduced (e.g., by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, or about 100%) degradation (e.g., by neutral endopeptidase (NEP), insulin degrading enzyme (IDE), or any other enzyme that cleaves a natriuretic peptide in vivo), as compared to a control (e.g., CNP22, CNP53, or any polypeptide described herein, such as a peptide described in International Application Pub. No. WO2010/135541 or U.S. Application Pub. No. 2010-0331256).

In some embodiments of any of the above aspects, the polypeptide of the invention may have increased (e.g., by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, about 100%, or more) efficacy and/or reduced (e.g., by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, or about 100%) dose-dependent side effects (e.g., decreased adverse hemodynamic effects, such as decreased lowering of blood pressure), as compared to a control (e.g., any polypeptide described herein, such as a peptide described in International Application Pub. No. WO2010/135541 or U.S. Application Pub. No. 2010-0331256).

In any of the aspects described herein, the polypeptide of the invention (e.g., an sALP polypeptide or an NP polypeptide) is glycosylated or pegylated. In some embodiments, the pharmaceutical composition includes a dimer of one or more of the polypeptides of the invention. In some embodiments, the pharmaceutically acceptable excipient includes saline. In some embodiments, the pharmaceutical composition is lyophilized. In some embodiments, the pharmaceutical composition is administered subcutaneously, intravenously, orally, nasally, intramuscularly, sublingually, intrathecally, or intradermally, e.g., subcutaneously.

In some embodiments, the pharmaceutical composition is administered to the subject in a dosage between about 0.5 mg/kg to about 500 mg/kg once, twice, three times, or four times daily. The dosage may be between, e.g., about 5 mg/kg to about 200 mg/kg, e.g., about 10 mg/kg to about 100 mg/kg, once, twice, three times, or four times daily. In some embodiments, the dosage is about 10 mg/kg or about 100 mg/kg twice daily.

In some embodiments, the pharmaceutical composition is administered to the subject in a dosage between about 0.5 mg/kg to about 500 mg/kg once or twice weekly. The dosage may be between, e.g., about 5 mg/kg to about 200 mg/kg, e.g., about 10 mg/kg to about 100 mg/kg, e.g., about 20 mg/kg to about 40 mg/kg, once or twice weekly. In some embodiments, the dosage is about 10 mg/kg, about 30 mg/kg, or about 100 mg/kg, once or twice weekly.

In some embodiments, the pharmaceutical composition is administered to the subject in a dosage between about 10 μg/kg to about 1,000 μg/kg once or twice weekly. The dosage may be between, e.g., about 20 μg/kg to about 800 μg/kg, e.g., about 30 μg/kg to about 600 μg/kg, e.g., about 50 μg/kg to about 500 μg/kg, e.g., about 100 μg/kg to about 400 μg/kg, e.g., about 200 μg/kg to about 300 μg/kg, once or twice weekly. In some embodiments, the dosage is about 30 μg/kg, about 100 μg/kg, about 300 μg/kg, or about 500 μg/kg, once or twice weekly.

In any of the aspects described herein, the pharmaceutical composition is administered to the subject in a dosage between about 0.1 mg/kg to about 500 mg/kg of one or more of the polypeptides of the invention in a dosage regimen of once, twice, three times, or four times daily. The dosage may be between, e.g., about 1 mg/kg to about 200 mg/kg, e.g., about 2 mg/kg to about 100 mg/kg or about 10 mg/kg to about 100 mg/kg of one or more of the polypeptides of the invention in a dosage regimen of once, twice, three times, or four times daily. In some embodiments, the dosage is about 10 mg/kg or about 100 mg/kg of one or more of the polypeptides of the invention in a dosage regimen of twice daily. For example, the methods of the invention may optionally include administering a pharmaceutical composition including the polypeptides of the invention (e.g., an sALP polypeptide and/or an NP polypeptide) to the subject in a dosage of about 0.5 mg/kg/day to about 10 mg/kg/day (e.g., about 2 mg/kg/day to about 3 mg/kg/day).

In any of the aspects described herein, the pharmaceutical composition is administered to the subject between one and fourteen times a week, or is administered at least once daily for at least one month. In some embodiments, the pharmaceutical composition is administered to the subject once weekly for at least one month. In some embodiments, the pharmaceutical composition is administered one time, two times, three times, or four times a week, e.g., three times a week.

Any of the pharmaceutical compositions of the invention may optionally be formulated for treating a disease or condition (e.g., any described herein) in a subject.

Any of the pharmaceutical composition of the invention featuring an isolated nucleic acid may optionally include a recombinant expression vector (e.g., a lentiviral vector) including the isolated nucleic acid. In some embodiments, the pharmaceutical composition includes about 0.1 mg to about 10 mg of the isolated nucleic acid.

In any embodiment described herein, the polypeptide may or may not be isolated.

In any embodiment described herein, the subject may be human.

In any of the aspects described herein, the combination of two or more polypeptides of the invention (e.g., any sALP polypeptide and/or any NP polypeptide described herein) or two or more compositions of the invention provides a synergistic effect. In particular embodiments, the synergistic effect is a therapeutic effect that is observed for the combination of two or more polypeptides of the invention, wherein one or more of the polypeptides of the invention is present at a dose that is normally non-therapeutic; or a therapeutic effect that results in an unexpected decrease in one or more adverse events (e.g., hemodynamic effects, such as a decrease in blood pressure, such as systolic arterial blood pressure, diastolic arterial blood pressure, or mean arterial blood pressure, that results in adverse hypotensive effects); or a therapeutic effect that results in reduced dose-dependent side effects, as compared to the level of dose-dependent side effects observed for a single polypeptide of the invention at a therapeutic dose.

In some embodiments of any of the methods described herein, the disease is the neurocutaneous syndrome (e.g., neurofibromatosis (e.g., classic von Recklinghausen type (type I), either with gastrointestinal stromal tumors (i.e., as in intestinal neurofibromatosis (type 3B)) or without such tumors; an acoustic neuroma type (type II); a mixed type that combines the features of types I and II with predominant features, such as bilateral acoustic neuromas, posterior fossa and upper cervical meningiomas, and spinal/paraspinal neurofibromas (type III, Riccardi type or type 3A); an atypical type that is distinguished from by the lack of iris Lisch nodules that are characteristic of type I (type VI); segmental neurofibromatosis, which is a variant of type I having lesions affecting a specific area of the body, such as a single segment of the body or an area that crosses the midline (type V); a type having only the symptoms of café au lait spots without other manifestations of neurofibromatosis (type VI); familial spinal neurofibromatosis, which is caused by mutation in the neurofibromin gene NF1 and considered a distinguishable variant of type I; other variants of type I, such as neurofibromatosis-pheochromocytoma-duodenal carcinoid syndrome; neurofibromatosis with manifestations of Noonan syndrome, such as short stature, ptosis, midface hypoplasia, webbed neck, learning disabilities, and muscle weakness; and schwannomatosis, where any of these disorders can include or exclude one or more bone manifestations); tuberous sclerosis; Sturge-Weber disease; ataxia telangiectasia; von Hippel-Lindau disease; incontinentia pigmenti; epidermal nevus syndromes, such as linear sebaceous nevus of Jadassohn; nevoid basal cell carcinoma syndrome; hypomelanosis of Ito; neurocutaneous melanosis; Klippel-Ternaunay syndrome; and Waardenburg syndrome, including types I, II, III, and IV). In some embodiments, the neurocutaneous syndrome has one or more bone manifestations. In some embodiments, the neurocutaneous syndrome is neurofibromatosis type I. In some embodiments of any of the methods described herein, the disease is any syndrome (e.g., a neurocutaneous syndrome) with overactivated RAS and/or ERK signaling (e.g., Noonan syndrome, Costello syndrome, Noonan syndrome with multiple lentigines/LEOPARD syndrome, neurofibromatosis type 1, hereditary gingival fibromatosis type 1, NF1-Noonan syndrome, capillary malformation-AV malformation syndrome, Legius syndrome, Noonan syndrome-like disorder with loose anagen hair, Noonan syndrome-like disorder with juvenile myelomonocytic leukemia (JMML), cardio-facio-cutaneous syndrome, or autoimmune lymphoproliferative syndrome, where any of these disorders can include or exclude one or more bone manifestations). In some embodiments of any of the methods described herein, the disorder associated with overactivation of FGFR3 is a bone or cartilage disorder, e.g., a skeletal dysplasia, such as any described herein, e.g., achondroplasia or craniosynostosis. In some embodiments of any of the methods described herein, the disorder is a bone or cartilage disorder, e.g., a skeletal dysplasia, such as any described herein. In some embodiments, the bone or cartilage disorder is a skeletal dysplasia, e.g., achondroplasia, homozygous achondroplasia, heterozygous achondroplasia, achondrogenesis, acrodysostosis, acromesomelic dysplasia, atelosteogenesis, camptomelic dysplasia, chondrodysplasia punctata, rhizomelic type of chondrodysplasia punctata, cleidocranial dysostosis, congenital short femur, craniosynostosis (e.g., Muenke syndrome, Crouzon syndrome, Apert syndrome, Jackson-Weiss syndrome, Pfeiffer syndrome, or Crouzonodermoskeletal syndrome), dactyl), brachydactyl), camptodactyl), polydactyl), syndactyl), diastrophic dysplasia, dwarfism, dyssegmental dysplasia, enchondromatosis, fibrochondrogenesis, fibrous dysplasia, hereditary multiple exostoses, hypochondroplasia, hypophosphatasia, hypophosphatemic rickets, Jaffe-Lichtenstein syndrome, Kniest dysplasia, Kniest syndrome, Langer-type mesomelic dysplasia, Marfan syndrome, McCune-Albright syndrome, micromelia, metaphyseal dysplasia, Jansen-type metaphyseal dysplasia, metatrophic dysplasia, Morquio syndrome, Nievergelt-type mesomelic dysplasia, neurofibromatosis (e.g., type 1, e.g., with bone manifestations or without bone manifestations; type 2; schwannomatosis; or any described herein), osteoarthritis, osteochondrodysplasia, osteogenesis imperfecta, perinatal lethal type of osteogenesis imperfecta, osteopetrosis, osteopoikilosis, peripheral dysostosis, Reinhardt syndrome, Roberts syndrome, Robinow syndrome, short-rib polydactyly syndromes, short stature, spondyloepiphyseal dysplasia congenita, spondyloepimetaphyseal dysplasia, or thanatophoric dysplasia. In some embodiments, the bone or cartilage disorder is optionally hypophosphatasia (e.g., infantile HPP, childhood HPP, perinatal HPP, adult HPP, or odontohypophosphatasia). In some embodiments, the pharmaceutical composition is administered in an amount that is therapeutically effective to treat an achondroplasia phenotype selected from the group consisting of growth retardation, skull deformities, and orthodontic defects. In some embodiments, the pharmaceutical composition is administered in an amount that is therapeutically effective to treat an achondroplasia phenotype selected from the group consisting of cervical cord compression, spinal stenosis, hydrocephalus, hearing loss due to chronic otitis, cardiovascular disease, neurological disease, and obesity. In some embodiments of any of the methods described herein, the disorder associated with overactivation of FGFR3 is cancer, e.g., multiple myeloma, myeloproliferative syndrome, leukemia, plasma cell leukemia, lymphoma, glioblastoma, prostate cancer, bladder cancer, or mammary cancer. In some embodiments of any of the methods described herein, the vascular smooth muscle disorder is hypertension, restenosis, arteriosclerosis, acute decompensated heart failure, congestive heart failure, cardiac edema, nephredema, hepatic edema, acute renal insufficiency, or chronic renal insufficiency. In some embodiments of any of the methods described herein, the condition for elongation of bone is insufficient or impaired bone growth arising from fractures, renal failure or insufficiency, poor diet, vitamin deficiency, hormone deficiency, or any skeletal dysplasia described herein.

In any method described herein, the neurocutaneous syndrome, disorder associated with overactivation of FGFR3, bone or cartilage disorder, vascular smooth muscle disorder, or condition for elongation of bone in the subject is thereby treated.

In some embodiments of any of the methods described herein, one or more polypeptides of the invention or one or more compositions of the invention is optionally administered in an amount that is therapeutically effective to treat a HPP phenotype selected from the group consisting of HPP-related seizure, premature loss of deciduous teeth, incomplete bone mineralization, elevated blood and/or urine levels of inorganic pyrophosphate ($PP_i$), elevated blood and/or urine levels of phosphoethanolamine (PEA), elevated blood and/or urine levels of pyridoxal 5'-phosphate (PLP), inadequate weight gain, rickets, bone pain, calcium pyrophosphate dihydrate crystal deposition, aplasia, hypoplasia, and dysplasia of the dental cementum. In some embodiments, the incomplete bone mineralization is incomplete femoral bone mineralization, incomplete tibial bone mineralization, incomplete metatarsal bone mineralization, or incomplete rib bone mineralization.

Definitions

As used herein, the term "about" means±10% of the recited value.

By "area under the curve" or "AUC" in the context of an in vivo pharmacokinetic assay is meant the area under the serum concentration vs. time curve after administration in an animal.

By "bone or cartilage disorder" is meant any disorder, disease, or other abnormality that affects the function, structure, or growth of bone or cartilage.

By "bone-targeting moiety" is meant an amino acid sequence of between 6 and 20 amino acid residues in length having a sufficient affinity to the bone matrix such that the bone-targeting moiety, taken alone, has an in vivo binding affinity to the bone matrix that is at least $10^{-6}$ M or better (e.g., $10^{-7}$ M, $10^{-8}$ M, $10^{-9}$ M, or better).

By "cathepsin cleavage sequence" is meant an amino acid sequence having a site that can be cleaved by cathepsin with a $k_{cat}/K_m$ rate constant of at least $10^3$ $M^{-1}s^{-1}$ (e.g., $10^4$ $M^{-1}s^{-1}$, $10^5$ $M^{-1}s^{-1}$, $10^6$ $M^{-1}s^{-1}$, $10^7$ $M^{-1}s^{-1}$, or $10^8$ $M^{-1}s^{-1}$) at 30° C. or higher (e.g., 37° C.). In particular embodiments, the cathepsin cleavage sequence is specific for cathepsin K. Exemplary cathepsin cleavage sequences are P2-P1-P1', where cleavage by the enzyme would occur at the P1-P1' peptide bond; P2 is preferentially composed of Pro, Leu, Ile, but could also be Val, Norleucine, Met, or Ala; P1 is preferentially Arg, Lys, Gln, but could also be Met, Norleucine, Leu, Ile, or Thr; and P1' can be any amino acid but is preferentially Gly. Additional cathepsin cleavage sequences are provided in Choe et al., J. Biol. Chem. 281(18):12824-832, 2006, which is incorporated herein by reference.

By "CNP22" is meant human CNP22 (SEQ ID NO: 4), unless a different meaning is expressly indicated.

By "CNP53" is meant human CNP53 (SEQ ID NO: 11), unless a different meaning is expressly indicated.

By "condition for elongation of bone" is meant any disorder, disease, or other abnormality that would benefit from lengthening of one or more segments of bone. After administration of any polypeptide described herein, the lengthening of one or more segments of bone can be increased by more than about 1%, about 2%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, or about 100%, or more.

By "disorder associated with overactivation of FGFR3" is meant any disorder, disease, or other abnormality that is caused by, or is associated with, overactivation of FGFR3, e.g., stemming from a gain-of-function FGFR3 mutation.

By "efficacy" is meant the $E_{max}$ value of a compound in a dose-response assay.

By "Fc" is meant a fragment crystallizable region of an immunoglobulin, e.g., IgG-1, IgG-2, IgG-3, IgG-3 or IgG-4, including the $C_{H2}$ and $C_{H3}$ domains of the immunoglobulin heavy chain. Fc may also include any portion of the hinge region joining the Fab and Fc regions. The Fc can be of any mammal, including human, and may be post-translationally modified (e.g., by glycosylation). In a non-limiting example, Fc can be the fragment crystallizable region of human IgG-1 having the amino acid sequence of SEQ ID NO: 401.

By "fragment" is meant a portion of a polypeptide or nucleic acid molecule that contains, preferably, at least 10%, 20%, 30%, 40%, 50%, 60%, 70%, 75%, 80%, 85%, 90%, 95%, 96%, 97%, 98%, 99%, or more of the entire length of the reference nucleic acid molecule or polypeptide. A fragment may contain, e.g., 10, 15, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 500, 600, 700, 800, 900, 1,000, 1100, 1200, 1300, 1400, 1500, 1600, 1700, 1800, 1900, 2000, 2100, or more nucleotides, up to the entire length of the nucleic acid molecule, or 10, 15, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, 400, 500, 600, 700, or more amino acid residues, up to the entire length of the polypeptide. Exemplary sALP fragments have amino acid residues 18-498, 18-499, 18-500, 18-501, 18-502, 18-503, 18-504, 18-505, 18-506, 18-507, 18-508, 18-509, 18-510, 18-511, or 18-512 of an consensus sequence for ALP (e.g., SEQ ID NOs: 1215, 1216, 1218, or 1219), and may include additional N-terminal and/or C-terminal portions. Exemplary NP fragments have at least a consensus ring domain, e.g., of SEQ ID NOs: 6, 30, or 95, and may include additional N-terminal and/or C-terminal portions.

By "homolog" is meant a polypeptide or nucleic acid molecule exhibiting at least 50% identity to a reference amino acid sequence or nucleic acid sequence. Such a sequence is generally at least, e.g., 50%, 60%, 70%, 75%, 80%, 85%, 90%, 95%, 96%, 97%, 98%, or 99% identical at the amino acid level or nucleic acid to a reference sequence. In general, for polypeptides, the length of comparison sequences can be at least five amino acid residues, e.g., 10, 20, 30, 40, 50, 60, 70, 80, 90, 100, 125, 150, 175, 200, 250, 300, 400, 500, 600, 700, or more amino acid residues, up to the entire length of the polypeptide. For nucleic acids, the length of comparison sequences can generally be at least 10, 20, 30, 40, 50, 60, 70, 80, 90, 100, 125, 150, 175, 200, 250, 300, 400, 500, 600, 700, 800, 900, 1000, 1100, 1200, 1300, 1400, 1500, 1600, 1700, 1800, 1900, 2000, 2100, or more nucleotides, up to the entire length of the nucleic acid molecule. It is understood that for the purposes of determining sequence identity when comparing a DNA sequence to an RNA sequence, a thymine nucleotide is equivalent to a uracil nucleotide.

As used herein, when a polypeptide or nucleic acid sequence is referred to as having "at least X % sequence identity" to a reference sequence, it is meant that at least X percent of the amino acid residues or nucleotides in the polypeptide or nucleic acid are identical to those of the reference sequence when the sequences are optimally aligned. An optimal alignment of sequences can be determined in various ways that are within the skill in the art, for instance, the Smith Waterman alignment algorithm (Smith et al., J. Mol. Biol. 147:195-7, 1981) and BLAST (Basic Local Alignment Search Tool; Altschul et al., J. Mol. Biol. 215: 403-10, 1990). These and other alignment algorithms are accessible using publicly available computer software such as "Best Fit" (Smith and Waterman, Advances in Applied Mathematics, 482-489, 1981) as incorporated into GeneMatcher Plus™ (Schwarz and Dayhof, Atlas of Protein Sequence and Structure, Dayhoff, M. O., Ed pp 353-358, 1979), BLAST, BLAST-2, BLAST-P, BLAST-N, BLAST-X, WU-BLAST-2, ALIGN, ALIGN-2, CLUSTAL, or Megalign (DNASTAR). In addition, those skilled in the art can determine appropriate parameters for measuring alignment, including any algorithms needed to achieve optimal alignment over the length of the sequences being compared.

By "hybridize" is meant to pair to form a double-stranded molecule between complementary polynucleotides, or portions thereof, under various conditions of stringency. (See, e.g., Wahl, G. M. and S. L. Berger (1987) Methods Enzymol. 152:399; Kimmel, A. R. (1987) Methods Enzymol. 152: 507.) For example, high stringency salt concentration will ordinarily be less than about 750 mM NaCl and 75 mM trisodium citrate, less than about 500 mM NaCl and 50 mM trisodium citrate, or less than about 250 mM NaCl and 25 mM trisodium citrate. Low stringency hybridization can be obtained in the absence of organic solvent, e.g., formamide, while high stringency hybridization can be obtained in the presence of at least about 35% formamide or at least about 50% formamide. High stringency temperature conditions will ordinarily include temperatures of at least about 30° C., 37° C., or 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In one embodiment, hybridization will occur at 30° C. in 750 mM NaCl, 75 mM trisodium citrate, and 1% SDS. In an alternative embodiment, hybridization will occur at 37° C. in 500 mM NaCl, 50 mM trisodium citrate, 1% SDS, 35% formamide, and 100 µg/ml denatured salmon sperm DNA (ssDNA). In a further alternative embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, high stringency salt concentrations for the wash steps may be, e.g., less than about 30 mM NaCl and 3 mM trisodium citrate, or less than about 15 mM NaCl and 1.5 mM trisodium citrate. High stringency temperature conditions for the wash steps will ordinarily include a temperature of, e.g., at least about 25° C., 42° C., or 68° C. In one embodiment, wash steps will occur at 25° C. in 30 mM NaCl, 3 mM trisodium citrate, and 0.1% SDS. In an alternative embodiment, wash steps will occur at 42° C. in 15 mM NaCl, 1.5 mM trisodium citrate, and 0.1% SDS. In a further alternative embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "isolated" or "purified" is meant separated from other naturally accompanying components. Typically, a compound (e.g., polypeptide, nucleic acid, or small molecule), factor, cell, or other component is considered isolated when it is at least, e.g., 50%, 60%, 70%, 75%, 80%, 85%, 90%, 95%, 96%, 97%, 98%, or even 99%, by weight, free from proteins, antibodies, naturally-occurring organic molecules, and other components with which it is naturally associated. In some instances, the component is at least 75%, 90%, or even 99%, by weight, pure. An isolated component may be obtained by chemical synthesis, separation of the factor from natural sources, or production of the component in a recombinant host cell that does not naturally produce the component. Proteins and small molecules may be purified by one skilled in the art using standard techniques such as those described by Ausubel et al. (Current Protocols in Molecular Biology, John Wiley & Sons, New York, 2000). The component is preferably at least, e.g., 2, 5, or 10 times as pure as the starting material, as measured using, e.g., polyacrylamide gel electrophoresis, column chromatography, optical density, HPLC analysis, or Western analysis (Ausubel et al., supra). Exemplary methods of purification are column chromatography, immunoprecipitation, and magnetic bead immunoaffinity purification.

By "natriuretic peptide that is an agonist of natriuretic peptide receptor B" (abbreviated "NP") is meant a natriuretic peptide as described herein, e.g., human CNP22 (SEQ ID NO: 4), or variant thereof, that is capable of agonizing NPR-B, e.g., human NPR-B, with at least 0.000001, 0.000005, 0.00001, 0.00005, 0.0001, 0.0005, 0.001, 0.005, 0.01, 0.05, 0.1, 0.5, 0.9, or 1 times the potency, and at least 1%, 2%, 5%, 10%, 20%, 30%, 40%, 50%, 60%, 70%, 80%, 90%, 95%, 95%, or even 100% times the efficacy of CNP22 as measured in a standard NPR-B activation assay, e.g., a membrane assay or whole cell assay, as described herein. Variant NPs may include one or more substitutions, additions or deletions relative to CNP22 and have the ability to agonize NPR-B. An NP as described herein may include any other sequence or moiety, attached covalently or non-covalently, provided that the NP has the ability to agonize NPR-B.

By "neurocutaneous syndrome" is meant a neurological disorder with one or more cutaneous manifestations, such as lesions on the skin and/or the eye. Such syndromes can optionally be accompanied by benign or malignant tumors in multiple sites of the body.

By "NP polypeptide" is meant any sequence including an NP sequence, as defined herein. Exemplary NP polypeptides include those having the structure V-NP-W, wherein each of V and W is absent or is an amino acid sequence of at least one amino acid (e.g., any NP fusion polypeptide described herein).

By "nucleic acid molecule" is meant a molecule, e.g., RNA or DNA, having a sequence of two or more covalently bonded, naturally occurring or modified nucleotides. The nucleic acid molecule may be, e.g., single or double stranded, and may include modified or unmodified nucleotides, or mixtures or combinations thereof. Various salts, mixed salts, and free acid forms are also included.

The terms "peptide," "polypeptide," and "protein" are used interchangeably and refer to any chain of two or more natural or unnatural amino acid residues, regardless of post-translational modification (e.g., glycosylation or phosphorylation), constituting all or part of a naturally-occurring or non-naturally occurring polypeptide or peptide, as is described herein.

As used herein, a natural amino acid is a natural α-amino acid having the L-configuration, such as those normally occurring in natural polypeptides. Unnatural amino acid refers to an amino acid that normally does not occur in polypeptides, e.g., an epimer of a natural α-amino acid having the L configuration, that is to say an amino acid having the unnatural D-configuration; or a (D,L)-isomeric mixture thereof; or a homolog of such an amino acid, for example, a β-amino acid, an α,α-disubstituted amino acid, or an α-amino acid wherein the amino acid side chain has been shortened by one or two methylene groups or lengthened to up to 10 carbon atoms, such as an α-amino alkanoic acid with 5 up to and including 10 carbon atoms in a linear chain, an unsubstituted or substituted aromatic (α-aryl or α-aryl lower alkyl), for example, a substituted phenylalanine or phenylglycine.

By "pharmaceutically acceptable carrier" or "pharmaceutically acceptable excipient" is meant a carrier or excipient that is physiologically acceptable to the treated patient while retaining the therapeutic properties of the compound with which it is administered. One exemplary pharmaceutically acceptable carrier substance is physiological saline. Other physiologically acceptable carriers and their formulations are known to those skilled in the art and described, for example, in Remington's Pharmaceutical Sciences, (20th edition), ed. A. Gennaro, 2000, Lippincott, Williams & Wilkins, Philadelphia, Pa.

By "pharmaceutical composition" is meant a composition containing a polypeptide or nucleic acid molecule as described herein formulated with a pharmaceutically acceptable excipient, and manufactured or sold with the approval of a governmental regulatory agency as part of a therapeutic regimen for the treatment or prevention of a disease or event in a subject. Pharmaceutical compositions can be formulated, for example, for subcutaneous administration, intravenous administration (e.g., as a sterile solution free of particulate emboli and in a solvent system suitable for intravenous use), for oral administration (e.g., a tablet, capsule, caplet, gelcap, or syrup), or any other formulation described herein, e.g., in unit dosage form.

By "potency" is meant the reciprocal of the $EC_{50}$ value of a compound in a dose-response assay. When comparing potency between a compound and a control or between an assay and a control assay, decreased potency indicates an increased $EC_{50}$ value, and increased potency indicates a decreased $EC_{50}$ value, as compared to the $EC_{50}$ value for the control or the control assay.

By "reduced degradation" is meant having a lower percentage of degraded peptide after exposure to an enzyme for at least 5, 10, 15, 20, 25, 30, 60, 120, 180, or 240 minutes, or higher, or any range between any two of these values, as compared to a percentage of degraded control, such as CNP22, CNP53, or any polypeptide described herein, such as a peptide described in International Application Pub. No. WO2010/135541 or U.S. Application Pub. No. 2010-0331256. The percentage of degraded peptide can be lower by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, or about 100%, where the percentage of degraded peptide can be determined by measuring the percentage of degraded peptide directly or indirectly by measuring the percentage of remaining peptide after exposure to an enzyme (e.g., neutral endopeptidase, insulin degrading enzyme, and any other enzyme that cleaves a natriuretic peptide in vivo) and subtracting this percentage of remaining peptide from 100%. Percentage of degraded peptide or remaining peptide can be measured by any useful method, such as liquid chromatography (e.g., high performance liquid chromatography (HPLC)), mass spectrometry (MS), or combined analytic techniques (e.g., LC-MS).

By "reduced dose-dependent side effect" is meant a decrease in one or more adverse effects as a function of a dosage of a compound, as compared to a control (e.g., any polypeptide described herein, such as a peptide described in International Application Pub. No. WO2010/135541 or U.S. Application Pub. No. 2010-0331256). The decrease in one or more adverse effects can be by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, or about 100%, as determined by any useful assay for detecting the adverse effect. Exemplary adverse effects include hemodynamic effects, such as a decrease in blood pressure, such as systolic arterial blood pressure, diastolic arterial blood pressure, or mean arterial blood pressure, that results in adverse hypotensive effects, and assays to detect such hemodynamic effects include a sphygmomanometer or an implanted pressure transducer.

The terms "sALP," "soluble alkaline phosphatase," and "extracellular domain of an alkaline phosphatase" are used interchangeably and mean a soluble, non-membrane-bound alkaline phosphatase or a domain, biologically active fragment, or biologically active variant thereof. sALPs include, for example, an alkaline phosphatase lacking a C-terminal GPI signal sequence, e.g., a polypeptide including or consisting of the amino acid residues 18-502 of human TNALP (SEQ ID NO: 1208). sALPs further include, for example, soluble, non-membrane-bound forms of mammalian orthologs of human TNALP (e.g., polypeptides including or consisting of amino acid residues 16-502 or 18-502 of SEQ ID NO: 1206, amino acid residues 18-502 of SEQ ID NO: 1207, amino acid residues 18-502 of SEQ ID NO: 1209, amino acid residues 18-502 of SEQ ID NO: 1210, or amino acid residues 1-480 of SEQ ID NO: 1211), soluble, non-membrane-bound forms of human IALP, GALP, and PLALP (e.g., polypeptides including or consisting of amino acid residues 20-503 of SEQ ID NO: 1212, amino acid residues 20-503 of SEQ ID NO: 1213, or amino acid residues 23-506 of SEQ ID NO: 1214), and additional variants and analogs thereof which retain alkaline phosphatase activity, e.g., the ability to hydrolyze $PP_i$.

By "sALP polypeptide" is meant any sequence including an sALP sequence, as defined herein. Exemplary sALP polypeptides include those having the structure A-sALP-B, wherein each of A and B is absent or is an amino acid sequence of at least one amino acid (e.g., any sALP fusion polypeptide described herein).

By "selective for NPR-B over NPR-A" is meant having an $EC_{50(NPR-A)}/EC_{50(NPR-B)}$ ratio that is at least 1.25, 1.5, 2, 2.5, 3, 3.5, 4, 4.5, 5, 7.5, 10, 12.5, 15, 20, 25, 30, 35, 40, 45, 50, 55, 60, 65, 70, 75, 80, 85, 90, 95, 100, 110, 120, 125, 130, 140, 150, 160, 170, 180, 190, 200, 225, 250, 275, 300, 350, 400, 450, 500, 550, 600, 650, 700, 750, 800, 850, 900, 950, 1,000, 1,100, 1,200, 1,250, 1,300, 1,400, 1,500, 1,750, 2,000, 2,500, 3,000, 4,000, 5,000, 10,000, or higher, or any range between any two of these values, in an in vivo or in vitro dose-response assay, e.g., measuring cGMP production, as described herein. Alternatively, or in addition, the term "selective for NPR-B over NPR-A" means having an $AUC_{(NPR-B)}/AUC_{(NPR-A)}$ ratio that is at least 1.1, 1.2, 1.25, 1.3, 1.4, 1.5, 1.6, 1.7, 1.75, 1.8, 1.9, 2, 2.25, 2.5, 2.75, 3, 3.5, 4, 4.5, 5, 7.5, 10, 12.5, 15, 20, 25, 30, 35, 40, 45, 50, 55, 60, 65, 70, 75, 80, 85, 90, 95, 100, 110, 120, 125, 130, 140, 150, 160, 170, 180, 190, 200, 225, 250, 275, 300, 350, 400, 450, 500, 550, 600, 650, 700, 750, 800, 850, 900, 950, 1,000, 1,100, 1,200, 1,250, 1,300, 1,400, 1,500, 1,750, 2,000, 2,500, 3,000, 4,000, 5,000, 10,000, or higher, or any range between any two of these values, as described herein.

By "signal peptide" or "signal sequence" is meant an amino acid sequence that directs a polypeptide to the cellular membrane such that the polypeptide is secreted. Alternatively, the signal sequence may direct the polypeptide to an intracellular compartment or organelle, such as the Golgi apparatus. A signal sequence may be identified by homology, or biological activity, to a peptide sequence with the known function of targeting a polypeptide to a particular region of the cell. One of ordinary skill in the art can identify a signal sequence by using readily available software (e.g., Sequence Analysis Software Package of the Genetics Computer Group, University of Wisconsin Biotechnology Center, 1710 University Avenue, Madison, Wis. 53705, BLAST, or PILEUP/PRETTYBOX programs). A signal sequence can be one that is, for example, substantially identical to amino acid residues 1-25 of SEQ ID NO: 501 or to amino acid residues 1-17 of SEQ ID NO: 1201.

By "skeletal dysplasia" is meant a bone or cartilage disorder characterized by short stature or dwarfism.

By "subject" is meant a mammal, including, but not limited to, a human or non-human mammal, such as a bovine, equine, canine, ovine, or feline.

By a "synergistic" effect is meant a therapeutic effect observed following administration of two or more agents that is greater than the sum of the therapeutic effects observed following the administration of each single agent. In one example of synergy, a therapeutic effect is observed for the combination of two or more agents, wherein one or more of the agents is present at a dose that is normally non-therapeutic. In another example of synergy, the combination of two or more agents results in an unexpected decrease in one or more adverse events (i.e., a level or number of adverse events that is less than the sum of the adverse events observed following administration of the single agents). In another example, the combination of two or more agents at a therapeutic dose results in reduced dose-dependent side effects, as compared to the level of dose-dependent side effects observed for a single agent at a therapeutic dose.

By "therapeutically effective amount" is meant an amount of a polypeptide or nucleic acid molecule described herein that is sufficient to substantially treat, prevent, delay, suppress, or arrest any symptom of a neurocutaneous syndrome, a disorder associated with overactivation of FGFR3, a bone or cartilage disorder (e.g., achondroplasia), or a vascular smooth muscle disorder, or that is sufficient to substantially elongate bone. A therapeutically effective amount of a composition described herein may depend on the severity of the disorder being treated and the condition, weight, and general state of the subject and can be determined by an ordinarily-skilled artisan with consideration of such factors. A therapeutically effective amount of a composition described herein can be administered to a subject in a single dose or in multiple doses administered over a period of time.

By "treating," "treat," or "treatment" is meant the medical management of a patient with the intent to cure, ameliorate, stabilize, reduce the likelihood of, or prevent a neurocutaneous syndrome, a disorder associated with overactivation of FGFR3, a bone or cartilage disorder (e.g., achondroplasia), or a vascular smooth muscle disorder, or management of a healthy subject with the intent to elongate bone, e.g., by administering a pharmaceutical composition. This term includes active treatment, that is, treatment directed specifically toward the improvement or associated with the cure of a disease, pathological condition, disorder, or event, and also includes causal treatment, that is, treatment directed toward removal of the cause of the associated disease, pathological condition, disorder, or event. In addition, this term includes palliative treatment, that is, treatment designed for the relief of symptoms rather than the curing of the disease, pathological condition, disorder, or event; symptomatic treatment, that is, treatment directed toward constitutional symptoms of the associated disease, pathological condition, disorder, or event; preventative treatment, that is, treatment directed to minimizing or partially or completely inhibiting the development of the associated disease, pathological condition, disorder, or event, e.g., in a patient who is not yet ill, but who is susceptible to, or otherwise at risk of, a particular disease, pathological condition, disorder, or event; and supportive treatment, that is, treatment employed to supplement another specific therapy directed toward the improvement of the associated disease, pathological condition, disorder, or event.

By "vascular smooth muscle disorder" is meant any disorder, disease, or other abnormality that affects the function, structure, or growth of vascular smooth muscle.

By "vector" is meant a DNA molecule, usually derived from a plasmid or bacteriophage, into which fragments of DNA may be inserted or cloned. A recombinant vector will contain one or more unique restriction sites, and may be capable of autonomous replication in a defined host or vehicle organism such that the cloned sequence is reproducible. A vector contains a promoter operably linked to a gene or coding region such that, upon transfection into a recipient cell, an RNA is expressed.

Other features and advantages of the invention will be apparent from the detailed description and from the claims.

BRIEF DESCRIPTION OF THE DRAWINGS

In figures showing a multiple sequence alignment, "*" represents identity; ":" represents a conserved substitution; and "." represents a semi-conserved substitution.

FIG. 3A shows the effect of recombinant human bone morphogenetic protein 2 (rhBMP2) in osteoblasts from wild-type mice (labeled "WT") and $NF1_{col2}{}^{-/-}$ mice. Cell plates are shown with histological staining for alkaline phosphatase (ALP) alone or in combination with alizarin red S (ALP/Alizarin) and for cell number with crystal violet.

FIG. 4C shows the in vivo effect of an NP fusion polypeptide (NC2B, SEQ ID NO: 504) on naso-anal length in wild-type mice (labeled "WT") and $NF1_{col2}{}^{-/-}$ mice. $NF1_{col2}{}^{-/-}$ mice were treated from day 1 to day 18 with 100 or 300 mg/kg of NC2B and compared to vehicle-treated or WT mice. Mice were measured for naso-anal length at day 19.

FIG. 4E shows the in vivo effect of an NP fusion polypeptide (NC2B, SEQ ID NO: 504) on growth plates in wild-type mice (labeled "WT") and $NF1_{col2}{}^{-/-}$ mice. $NF1_{col2}{}^{-/-}$ mice were treated from day 1 to day 18 with 300 mg/kg of NC2B and compared to vehicle-treated or WT mice. At day 19, tibias were used to analyze proximal growth plates in histology and to measure the size of chondrocyte zones.

FIG. 5A is a schematic diagram of the structure of human tissue nonspecific alkaline phosphatase (hsTNALP) as described herein, which includes a polypeptide having a TNALP ectodomain, an N-terminal signaling sequence, and a GPI signal sequence (top); a hsTNALP-$FcD_{10}$ having a TNALP ectodomain, an N-terminal signaling sequence, an $IgG_1$-Fc sequence, and a bone-targeting $D_{10}$ moiety (middle); and a hsTNALP-$FcD_{10}$ without a signal sequence having a TNALP ectodomain, an $IgG_1$-Fc sequence, and a bone-targeting $D_{10}$ moiety (bottom).

FIG. 5B shows the amino acid sequence of hsTNALP-$FcD_{10}$ (SEQ ID NO: 1201), including the N-terminal signal sequence (the first 17 amino acid residues, underlined and italicized; position 2, a valine, differs from the wild-type residue in that position, isoleucine); and the amino acid sequence of secreted hsTNALP-$FcD_{10}$ (SEQ ID NO: 1204), which lacks the N-terminal signal sequence. Amino acid residues of the hsTNALP portion of the polypeptides, which correspond to amino acid residues 18-502 of hsTNALP (SEQ ID NO: 1205), are italicized. The signal sequence in SEQ ID NO: 1201 is italicized and underlined. The Fc portions of the polypeptides (SEQ ID NO: 401) are underlined. A dipeptide leucine-lysine (LK) linker between the hsTNALP and Fc portions and a dipeptide aspartic acid-isoleucine (DI) linker between the hsTNALP and bone-targeting moiety are shown in bold.

FIG. 5C shows the amino acid sequence of sALP fusion proteins lacking a bone-targeting moiety: hsTNALP-Fc (SEQ ID NO: 1220) and secreted hsTNALP-$FcD_{10}$ (SEQ ID NO: 1221), which lacks the N-terminal signal sequence. Amino acid residues of the hsTNALP portion of the polypeptides, which correspond to amino acid residues 18-502 of hsTNALP (SEQ ID NO: 1205), are italicized. The signal sequence in SEQ ID NO: 1201 is italicized and underlined. The Fc portions of the polypeptides (SEQ ID NO: 401) are underlined. A dipeptide leucine-lysine (LK) linker between the hsTNALP and Fc portions are shown in bold.

FIG. 5D shows a nucleic acid sequence (SEQ ID NO: 1217) encoding the hsTNALP-Fc polypeptide depicted in FIG. 5B.

FIG. 6 shows amino acid sequences for human soluble tissue nonspecific alkaline phosphatase (hsTNALP), including the sequence of hsTNALP having the N-terminal signal sequence (amino acid residues 1-502) (SEQ ID NO: 1202) and the sequence of secreted hsTNALP lacking the signal sequence (amino acid residues 18-502) (SEQ ID NO: 1205). The signal sequence is underlined.

FIG. 7 is a listing of the amino acid sequence of an exemplary Fc from human IgG-1 (SEQ ID NO: 401).

FIG. 8 shows a CLUSTAL™ W (1.82) multiple sequence alignment of mammalian tissue nonspecific alkaline phosphatase (TNALP) orthologs. Mammalian TNALP orthologs include cow TNALP ("P09487|PPBT_BOVIN"; Accession No. P09487; SEQ ID NO: 1206); cat TNALP ("Q29486|PPBT_FELCA"; Accession No. Q29486; SEQ ID NO: 1207), human TNALP ("P05186|PPBT_HUMAN"; Accession No. P05186; SEQ ID NO: 1208), mouse TNALP ("P09242|PPBT_MOUSE"; Accession No. P09242; SEQ ID NO: 1209), rat TNALP ("P08289|PPBT_RAT"; Accession No. P08289; SEQ ID NO: 1210), and a partial sequence of dog TNALP ("Q9N0V0|Q9N0V0_CANFA"; Accession No. Q9N0V0; SEQ ID NO: 1211). A consensus sequence is derived from this alignment ("Consensus"; SEQ ID NO: 1216), where X denotes degenerate positions and can be any amino acid.

FIG. 9 shows a CLUSTAL™ (2.0.5) multiple sequence alignment of mammalian tissue nonspecific alkaline phosphatase (TNALP) orthologs and human alkaline phosphatase (ALP) isozymes. Mammalian TNALP orthologs include those shown in FIG. 8, including rat TNALP ("TNALPrn," SEQ ID NO: 1210), mouse TNALP ("TNALPmm," SEQ ID NO: 1209), human TNALP ("TNALPhs," SEQ ID NO: 1208), a partial sequence of dog TNALP ("TNALPcf," SEQ ID NO: 1211), cat TNALP ("TNALPfc," SEQ ID NO: 1207), and cow TNALP ("TNALPbt," SEQ ID NO: 1206). Human ALP isozymes include a human gastrointestinal ALP ("GALPhs"; Accession No. P10696; SEQ ID NO: 1213), a human placental ALP ("PLALPhs"; Accession No. 05187; SEQ ID NO: 1214), and a human intestinal ALP ("IALPhs"; Accession No. P09923; SEQ ID NO: 1212). A consensus sequence is derived from this alignment ("Consensus"; SEQ ID NO: 1215), where X denotes degenerate positions and can be any amino acid.

FIG. 10 is a consensus sequence (SEQ ID NO: 1218) for mammalian tissue nonspecific alkaline phosphatase (TNALP) orthologs and human alkaline phosphatase (ALP) isozymes excluding pathogenic mutations, where X can be any amino acid but not an amino acid corresponding to one or more pathogenic mutations provided in Table 1.

FIG. 11 is a consensus sequence (SEQ ID NO: 1219) for mammalian tissue nonspecific alkaline phosphatase (TNALP) orthologs excluding pathogenic mutations, where X can be any amino acid but not an amino acid corresponding to one or more pathogenic mutations provided in Table 1.

FIG. 12 is a multiple sequence alignment of human ANP (SEQ ID NO: 1), human urodilatin (SEQ ID NO: 2), human BNP (SEQ ID NO: 3), human CNP22 (SEQ ID NO: 4), and DNP (SEQ ID NO: 5). The 17-amino acid ring domain for each natriuretic peptide is shown in bold and enclosed in a box. A consensus sequence (SEQ ID NO: 6) is shown below, wherein each X represents any amino acid, or optionally represents any amino acid at the corresponding position in one of SEQ ID NOs: 1-5.

FIG. 13 is an alignment of human CNP53 (SEQ ID NO: 11), human CNP22, and human CNP (ring domain only) (SEQ ID NO: 12).

FIG. 14 is a multiple sequence alignment of various CNP22 homologs. The 17-amino acid ring domain for each NP is shown in bold and enclosed in a box. A consensus sequence (SEQ ID NO: 30) is shown below, wherein each X within the ring domain represents any amino acid, or optionally represents any amino acid at the corresponding position in one of SEQ ID NOs: 4 and 13-29. Each X outside the ring domain represents any amino acid or may be absent, or optionally represents any amino acid at the corresponding position in one of SEQ ID NOs: 4 and 13-29.

FIGS. 15A-15G are a multiple sequence alignment of various CNP homologs, in some cases including the N-terminal pre- and pro-sequences. The 17-amino acid ring domain for each NP is shown in bold and enclosed in a box. A consensus sequence (SEQ ID NO: 95) is shown below, wherein each X represents any amino acid, or optionally represents any amino acid at the corresponding position in one of SEQ ID NOs: 31-94.

FIGS. 17A-17E are schematic diagrams of exemplary Fc-NP or NP-Fc constructs. FIG. 17A depicts an Fc-NP dimer. FIG. 17B depicts an NP-Fc dimer.

FIG. 17C depicts an Fc:Fc-NP monomer-dimer hybrid. FIG. 17D depicts an NP-Fc:Fc monomer-dimer hybrid. FIG. 17E depicts an NP-Fc:Fc-NP hybrid dimer.

FIG. 18A is a listing of the amino acid sequence of the immature NC2 Streptag ("NC2st") fusion protein (SEQ ID NO: 501), together with a table providing a summary of protein regions. The N-terminal signal sequence, which is cleaved during translation, is underlined. Various linker sequences are shown in italics. The Fc domain is shown in bold. The CNP domain is shown in gray highlighting. FIG. 18B is a listing of the amino acid sequence of the NC2st fusion protein (SEQ ID NO: 502) without the signal sequence. FIG. 18C is a listing of the nucleic acid sequence (SEQ ID NO: 801) encoding the NC2st fusion protein.

FIG. 19A is a listing of the NC2B amino acid sequence, both with the signal sequence (SEQ ID NO: 503) and without the signal sequence (SEQ ID NO: 504), and the D10-NC2 amino acid sequence having a $D_{10}$ tag, both with the signal sequence (SEQ ID NO: 607) and without the signal sequence (SEQ ID NO: 608).

FIG. 19B is a listing of a nucleic acid sequence (SEQ ID NO: 802) encoding NC2B.

FIG. 20A is a listing of amino acid sequences for NC2B-22, NC2B-28, and NC2B-34, both with the signal sequence (SEQ ID NOs: 505, 507, and 509, respectively) and without the signal sequence (SEQ ID NOs: 506, 508, and 510, respectively). Signal sequences are underlined. The Fc domain is shown in bold. Linker sequences are shown in italics. The CNP domain is shown in gray highlighting. FIG. 20B is a listing of a nucleic acid sequence (SEQ ID NO: 803) encoding NC2B-22. FIG. 20C is a listing of a nucleic acid sequence (SEQ ID NO: 804) encoding NC2B-28. FIG. 20D is a listing of a nucleic acid sequence (SEQ ID NO: 805) encoding NC2B-34.

FIG. 21 is a listing of amino acid sequences for NC2-KGANKK and NC2-KGANQK, both with the signal sequence (SEQ ID NOs: 511 and 513, respectively) and without the signal sequence (SEQ ID NOs: 512 and 514, respectively). Signal sequences are underlined. The Fc domain is shown in bold. Linker sequences are shown in italics. The CNP domain is shown in gray highlighting.

FIG. 22 is a listing of amino acid sequences for NC2-CNP53mut2, both with the signal sequence (SEQ ID NO: 515) and without the signal sequence (SEQ ID NOs: 516). Signal sequence is underlined. The Fc domain is shown in bold. Linker sequences are shown in italics. The CNP domain is shown in gray highlighting.

FIG. 23 is a listing of amino acid sequences for Fc-CNP53-A (also referred to as Fc-CNP53 wt) and Fc-CNP53-AAA (also referred to as Fc-CNP53mut), both with the signal sequence (SEQ ID NOs: 517 and 519, respectively) and without the signal sequence (SEQ ID NOs: 518 and 520, respectively). Signal sequences are underlined. The Fc domain is shown in bold. Linker sequences are shown in italics. The CNP domain is shown in gray highlighting.

FIG. 24 is a multiple sequence alignment of various NPs and homologs, including CDNP. The boxed region is the most conserved region of the DNP tail among NPRA-binding peptides. The sequences of numerous CDNP variants are shown in the bottom half of the figure, and a consensus sequence (SEQ ID NO: 118) for the DNP C-terminal tail is also shown. Each X in the consensus sequence represents any amino acid, or optionally represents any amino acid at the corresponding position in one of SEQ ID NOs: 100-116.

FIG. 25A is a listing of amino acid sequences for CNP-16AAlinker-Fc-His10 (NC1) (SEQ ID NO: 521), CNP-6AAlinker-Fc-His10 (NC3) (SEQ ID NO: 522), CNP-6AA-linker-Fc (SEQ ID NO: 523), CDNP-Fc (SEQ ID NO: 524), CDNP-A17saa-Fc (SEQ ID NO: 525), and CDNP-A17sra-Fc (SEQ ID NO: 526). The CNP domain is shown in gray highlighting. Linker sequences are shown in italics. The Fc domain is shown in bold. FIG. 25B is a listing of the nucleic acid sequence (SEQ ID NO: 806) of NC1.

FIG. 26 is a listing of various point mutants (SEQ ID NOs: 119-125) each having a mutation at position 17 of CNP22, together with a consensus sequence (SEQ ID NO: 126). X represents any amino acid, or optionally represents any amino acid at the corresponding position in one of SEQ ID NOs: 119-125.

FIG. 27 is a listing of amino acid sequences for several CNP variants (SEQ ID NOs: 4 and 127-150). The 17-amino acid ring domain for each variant is shown in bold. The linker region is shown in italics.

FIGS. 28A-28E are a listing of amino acid sequences for additional CNP variants (SEQ ID NOs: 1001-1155).

FIG. 29 is a listing of amino acid sequences for CNP22 (SEQ ID NO: 4), CNP-L17 (SEQ ID NO: 120), CNP-F17 (SEQ ID NO: 119), CNP-T17 (SEQ ID NO: 122), D6-14AAlinker-CNP [C3] (SEQ ID NO: 147), CNP-14AA-linker-D6 [C4] (SEQ ID NO: 148), CNP-Nterm2 [C5] (SEQ ID NO: 150), CDNP-S3A4A5R6 [C13] (SEQ ID NO: 115), CDNP29-S3A4A5R6 [C14] (SEQ ID NO: 151), C1(E6) [BC1] (SEQ ID NO: 129), C2(E6) [BC2] (SEQ ID NO: 130), C3 (E6) [BC3] (SEQ ID NO: 131), C4(E6) [BC4] (SEQ ID NO: 132), C5(E6) [BC5] (SEQ ID NO: 133), C6(E6) [BC6] (SEQ ID NO: 134), C7(E6) [BC7] (SEQ ID NO: 135), C8(E6) [BC8] (SEQ ID NO: 136), C9(E6) [BC9] (SEQ ID NO: 137), C10(E6) [BC10] (SEQ ID NO: 138), C11(E6) [BC11] (SEQ ID NO: 139), PGCNP37(E6) (SEQ ID NO: 128), KA1 (SEQ ID NO:152), KA1(E6) (SEQ ID NO:153), KB1 (SEQ ID NO:154), and KB1(E6) (SEQ ID NO: 155). The 17-amino acid ring domain for each variant is shown in bold. The linker sequences are shown in italics. The cathepsin cleavage sequences are shown in underline.

FIG. 30 is a listing of amino acid sequences for CNP variants having a point mutation at position 17 relative to CNP22 (SEQ ID NOs: 126, 119-122, and 156-172). For SEQ ID NOs: 126 and 162, X can be any amino acid, including but not limited to F, L, I, T, E, R, Y, C, P, or D. The 17-amino acid ring domain for each variant is shown in bold. The linker sequences are shown in italics.

FIGS. 31A-31B are listings of amino acid sequences for additional CNP variants having a point mutation at position 17 relative to CNP22 (SEQ ID NOs: 173-220). X can be any amino acid, including but not limited to F, L, I, T, E, R, Y, C, P, or D. The 17-amino acid ring domain for each variant is shown in bold. The linker sequences are shown in italics. The cathepsin cleavage sequences are shown in underline.

FIG. 32 is a listing of amino acid sequences for CNP variants having a point mutation at position 17 relative to CNP22, where the methionine at position 17 has been substituted with a leucine (SEQ ID NOs: 221-233). The 17-amino acid ring domain for each variant is shown in bold. The linker sequences are shown in italics. The cathepsin cleavage sequences are shown in underline.

FIGS. 33A-33E are listings of amino acid sequences for constructs having a point mutation at position 17 relative to CNP22 (SEQ ID NOs: 527-552). X can be any amino acid, including but not limited to F, L, I, T, E, R, Y, C, P, or D. Signal sequences are underlined. The Fc domain is shown in bold. Linker sequences are shown in italics. The CNP domain is shown in gray highlighting.

FIGS. 34A-34J are listings of amino acid sequences for NC2 variants (SEQ ID NOs: 511-516 and 553-606) with or without the signal sequence and either with or without a $D_{10}$ bone-targeting moiety at the N-terminal. Signal sequences are underlined. The Fc domain is shown in bold. Linker sequences are shown in italics. The CNP domain is shown in gray highlighting.

DETAILED DESCRIPTION OF THE INVENTION

Figure 1A:
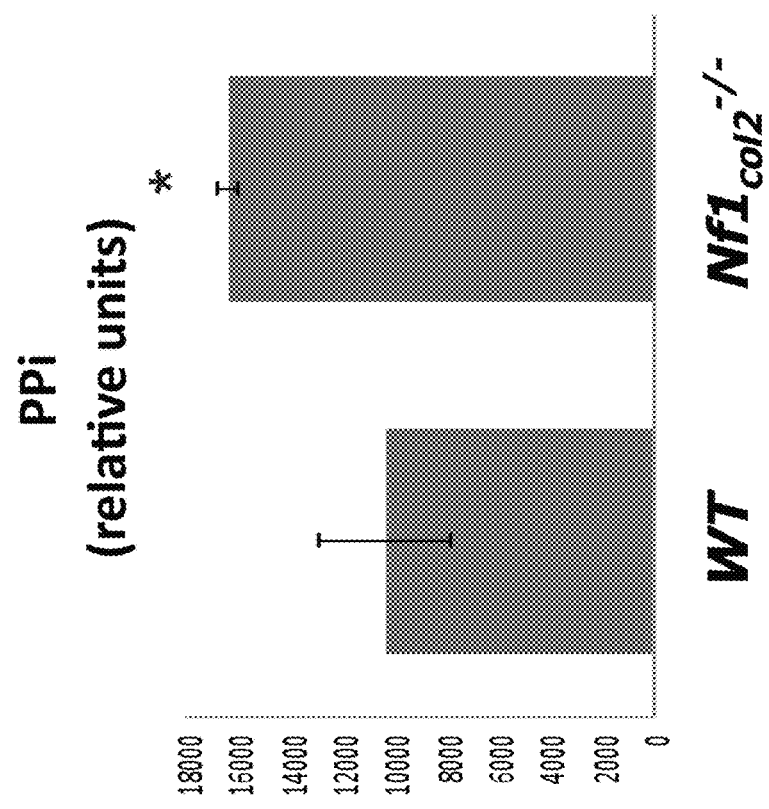
FIG. 1A is a graph showing levels of pyrophosphate ($PP_i$) in osteoblasts from wild-type mice (left) and $NF1_{col2}{}^{-/-}$ mice (right).

The present invention features soluble alkaline phosphatase (sALP) polypeptides, e.g., fused to an Fc domain of an immunoglobulin, nucleic acid encoding such, and their uses to treat any disease or condition described herein (e.g., neurocutaneous syndromes (e.g., neurofibromatosis, e.g., type 1), disorders associated with overactivation of FGFR3, bone or cartilage disorders (e.g., hypophosphatasia or achondroplasia), vascular smooth muscle disorders, as well as to elongate bone). The present invention also features natriuretic (NP) polypeptides, e.g., fused to an Fc domain of an immunoglobulin, nucleic acid encoding such, and their uses to treat any disease or condition described herein (e.g., neurocutaneous syndromes (e.g., neurofibromatosis, e.g., type 1), disorders associated with overactivation of FGFR3, bone or cartilage disorders (e.g., hypophosphatasia or achondroplasia), vascular smooth muscle disorders, as well as to elongate bone). The present invention also features a combination of such sALP polypeptides with such NP polypeptides, as described herein, and uses of this combination to treat any disease or condition described herein (e.g., neurocutaneous syndromes, disorders associated with overactivation of FGFR3, bone or cartilage disorders (e.g., hypophosphatasia or achondroplasia), vascular smooth muscle disorders, as well as to elongate bone). Additional details of the invention are provided below.

Alkaline Phosphatase

Alkaline phosphatases encompass a group of enzymes that share the property of being able to cleave phosphate in a variety of contexts (e.g., hydrolysis of pyrophosphate, $PP_i$). There are four known mammalian alkaline phosphatase (ALP) isozymes: tissue nonspecific alkaline phosphatase (TNALP; described further below), placental alkaline phosphatase (PLALP) (e.g., Accession Nos. P05187, NP_112603, and NP_001623), germ cell alkaline phosphatase (GALP) (e.g., Accession No. P10696), and intestinal alkaline phosphatase (IALP) (e.g., Accession Nos. P09923 and NP_001622). These isozymes possess very similar three dimensional structures. Each of their catalytic sites contains four metal binding domains that bind to metal ions necessary for enzymatic activity, including two zinc ions and one magnesium ion. These enzymes catalyze the hydrolysis of monoesters of phosphoric acid and also catalyze a transphosphorylation reaction in the presence of high concentrations of phosphate acceptors. It has been shown that PLALP is physiologically active toward phosphoethanolamine (PEA), inorganic pyrophosphate ($PP_i$), and pyridoxal 5'-phosphate (PLP), all three being known natural substrate for TNALP (Whyte, 1995). An alignment between these isozymes is shown in FIG. 9. Additional alkaline phosphatases are described, e.g., in WO 2008/138131 and in U.S. Publication No. 2006/0014687, which are hereby incorporated by reference.

Tissue nonspecific phosphatases are a family of proteins, encoded by a single gene, that differ from each other by post-translational modification. TNALPs are present predominantly in the liver, kidneys, and bone, but can occur throughout the body. Known TNALPs in mammals include, e.g., human TNALP (Accession Nos. NP_000469, AAI10910, AAH90861, AAH66116, AAH21289, and AAI26166); rhesus TNALP (Accession No. XP_01109717); rat TNALP (Accession No. NP_037191); dog TNALP (Accession No. AAF64516); pig TNALP (Accession No. AAN64273), mouse (Accession No. NP_031457), cow TNALP (Accession Nos. NP_789828, NP_776412, AAM 8209, and AAC33858), and cat TNALP (Accession No. NP_001036028), in addition to other examples provided herein.

Soluble Alkaline Phosphatase

The soluble alkaline phosphatases (sALP) of the invention include, for example, soluble (e.g., extracellular or non membrane-bound) forms of any of the alkaline phosphatases described herein. The soluble alkaline phosphatase of the invention can be, for example, a soluble form of human TNALP. A schematic representation of the domains of human TNALP (hTNALP) is shown in FIG. 5A (top). TNALP is a membrane-bound protein anchored through a glycolipid bound to its C-terminal (Swiss-Prot, P05186). This glycolipid anchor (GPI) is added post translationally after the removal of a hydrophobic C-terminal end, which serves both as a temporary membrane anchor and as a signal for the addition of the GPI. This GPI anchor is buried in the cell membrane, and the remaining portions of the protein are extracellular. TNALP, including hTNALP, can be engineered to replace the first amino acid of the hydrophobic C-terminal sequence (an alanine) with a stop codon. The engineered hTNALP so formed contains all amino acid residues of the native anchored form of TNALP but lacks the GPI membrane anchor. An hTNALP which is soluble is herein referred to as "hsTNALP." One skilled in the art will appreciate that the position of the GPI membrane anchor will vary in different alkaline phosphatases and may include, for example, the last 10, 12, 14, 16, 18, 20, 21, 22, 23, 24, 25, 26, 27, 28, 29, 30, 32, 34, 36, 38, 40, 45, 50, or more amino acid residues on the C-terminus of the polypeptide. For example, the GPI membrane anchor of the hTNALP (SEQ ID NO: 1208) is amino acid residues 503-524. The amino acid sequence of this hsTNALP (with one variation at position 2 of the signal sequence), as fused to Fc, is shown in FIG. 5B. The sequence of a nucleic acid encoding this hsTNALP-Fc fusion polypeptide is shown in FIG. 5D (SEQ ID NO: 1217).

In addition to the C-terminal GPI anchor, TNALP also has an N-terminal signal peptide sequence. The N-terminal signal peptide is initially present on the protein when it is synthesized, but is cleaved after translocation into the ER. Thus, the N-terminal signal peptide is absent from the secreted form of TNALP. The sALPs of the invention include both secreted (i.e., lacking the N-terminal signal) and non-secreted (i.e., having the N-terminal signal) forms thereof. One skilled in the art will appreciate that the position of the N-terminal signal peptide will vary in different alkaline phosphatases and may include, for example, the first 5, 8, 10, 11, 12, 13, 14, 15, 16, 17, 18, 19, 20, 21, 22, 23, 24, 25, 27, 30, or more amino acid residues on the N-terminus of the polypeptide. For example, the N-terminal signal peptide of the hTNALP of SEQ ID NO: 1208 is its first 17 amino acid residues, as shown in FIG. 6. Thus, a secreted, soluble form of this hTNALP is amino acid residues 18-502 of SEQ ID NO: 1208 (SEQ ID NO: 1205), as shown in FIG. 6. The amino acid sequence of this secreted hsTNALP, as fused to Fc, is shown in FIG. 5B. The sALPs of the invention include both secreted and non-secreted forms thereof. One of skill in the art can predict the position of a signal sequence cleavage site, e.g., by an appropriate computer algorithm such as that described in Bendtsen et al. (*J. Mol. Biol.* 340(4):783-795, 2004) and available on the Web at http://www.cbs.dtu.dk/services/SignalP/.

The sALPs of the invention also include, for example, polypeptide sequences satisfying a consensus sequence derived from the ALP extracellular domain of human ALP isozymes and of mammalian TNALP orthologs (human, mouse, rat, cow, cat, and dog) (SEQ ID NO: 1215, as shown in FIG. 9), or a consensus derived from the ALP extracellular domain of just mammalian TNALP orthologs (human, mouse, rat, cow, cat, and dog) (SEQ ID NO: 1216, as shown in FIG. 8). In some embodiments, the sALP includes amino acid residues 18-498, 18-499, 18-500, 18-501, 18-502, 18-503, 18-504, 18-505, 18-506, 18-507, 18-508, 18-509, 18-510, 18-511, or 18-512 of SEQ ID NO: 1216. In some embodiments, the sALP includes amino acid residues 23-498, 23-499, 23-500, 23-501, 23-502, 23-503, 23-504, 23-505, 23-506, 23-507, 23-508, 23-509, 23-510, 23-511, or 23-512 of SEQ ID NO: 1215.

The sALPs of the invention also include those which satisfy similar consensus sequences derived from various combinations of these TNALP orthologs or human ALP isozymes. Such consensus sequences are given, for example, in WO 2008/138131, herein incorporated by reference.

Furthermore, it has been shown that recombinant hsTNALP retaining original amino acid residues 1 to 501 (18 to 501 when secreted) (Oda et al., *J. Biochem.* 126: 694-699, 1999), amino acid residues 1 to 502 (18 to 502 when secreted) (WO 2008/138131), amino acid residues 1 to 504 (18 to 504 when secreted) (U.S. Pat. No. 6,905,689, which is herein incorporated by reference), and amino acid residues 1 to 505 (18-505 when secreted) (U.S. Pat. Pub. No. 2007/0081984, which is herein incorporated by reference), are enzymatically active. This indicates that certain amino acid residues can be truncated from the C-terminal end of the soluble hsTNALP polypeptide without affecting its enzymatic activity. This also indicates that certain amino acid residues of the GPI membrane anchor, when present, do not significantly affect the solubility of the polypeptide. Hence, the sALPs of the invention also include those where, e.g., up to five (e.g., one, two, three, four, or five) amino acid residues are truncated on its C-terminal end, and those where, e.g., up to five (e.g., one, two, three, four, or five) amino acid residues of the GPI membrane anchor are present. For example, non-secreted sALPs of the invention include those containing amino acid residues 1-497, 1-498, 1-499, 1-500, 1-501, 1-502, 1-503, 1-504, 1-505, 1-506, or 1-507 of SEQ ID NO: 1208, as well as variants thereof where the amino acid at position 2 is a valine, and secreted sALPs of the invention include those containing amino acid residues 18-497, 18-498, 18-499, 18-500, 18-501, 18-502, 18-503, 18-504, 18-505, 18-506, or 18-507 of SEQ ID NO: 1208.

One skilled in the art will appreciate that many mutations in the amino acid sequence of an enzyme will not significantly disrupt the catalytic function of the enzyme. In some cases, certain mutation may even benefit the catalytic function of the enzyme in the context of therapy for any disorder or condition described herein (e.g., a neurocutaneous syndrome or a bone or cartilage disorder). Therefore, the sALPs of the invention include not only the wild-type sequence of the alkaline phosphatases described above, but also include any polypeptide having at least 50% (e.g., 55%, 60%, 65%, 70%, 75%, 80%, 85%, 86%, 87%, 88%, 89%, 90%, 91%, 92%, 93%, 94%, 95%, 96%, 97%, 98%, 99%, or more) sequence identity to these alkaline phosphatases. It is known, however, that specific mutations in TNALP are known to cause HPP. Such pathogenic mutations are preferably absent in the sALPs of the invention. Thus, the sALPs of the invention include those having an amino acid sequence including a consensus sequence for multiple mammalian TNALP orthologs and human ALP isozymes that lack pathogenic mutations (SEQ ID NO: 1218, as shown in FIG. 10) or including a consensus sequence for multiple mammalian TNALP orthologs that lack pathogenic mutations (SEQ ID NO: 1219, as shown in FIG. 11). Exemplary sALPs of the invention include those containing amino acid residues 1-497, 1-498, 1-499, 1-500, 1-501, 1-502, 1-503, 1-504, 1-505, 1-506, 1-507, 1-508, 1-509, 1-510, 1-511, 1-512, 23-497, 23-498, 23-499, 23-500, 23-501, 23-502, 23-503, 23-504, 23-505, 23-506, 23-507, 23-508, 23-509, 23-510, 23-511, or 23-512 of SEQ ID NO: 1218, and secreted sALPs of the invention include those containing amino acid residues 18-497, 18-498, 18-499, 18-500, 18-501, 18-502, 18-503, 18-504, 18-505, 18-506, 18-507, 18-508, 18-509, 18-510, 18-511, or 18-512 of SEQ ID NO: 1219. In these consensus sequences (SEQ ID NOs: 1218 and 1219), X is any amino acid but is not an amino acid corresponding to a pathogenic mutation at that position of human TNALP. Examples of such pathogenic mutations are listed below and provided in Table 1.

TABLE 1

Pathogenic mutations for human TNALP*
Total number of mutations 188

| Exon | Base change | Amino acid change Non-standardized nomenclature | Amino acid change Standardized nomenclature | Reference | Clinical form in patient | Genotype of patient | % WT | ref. | E. coli | |
|---|---|---|---|---|---|---|---|---|---|---|
| 1 | c.-195C > T | | | Taillandier et al. 2000 | perinatal | c.-195C > T/C184Y | | | na | Affects transcription start site |
| 2 | c.17T > A | L-12X | p.L6X | Taillandier et al. 2000 | childhood | L-12X/? | | | na | Nonsense mutation |
| 2 | c.50C > T | S-1F | p.S17F | Mornet et al. 1998 | infantile | S-1F/G58S | 19.0 | 1 | na | |
| 3 | c.83A > G | Y11C | p.Y28C | Taillandier et al. 2001 | infantile | Y11C/R119H | 7.2 | 2 | − | |
| 3 | c.98C > T | A16V | p.A33V | Henthorn et al. 1992 | childhood | A16V/Y419H | | | − | |
| 3 | c.110T > C | L20P | p.L37P | Versailles lab October 2003 | perinatal | L20P/L20P | | | + | |
| 3 | c.119C > T | A23V | p.A40V | Mornet et al. 1998 | infantile | A23V/G456S | 2.3 | 1 | + | |
| 3 | c.132C > T | Q27X | p.Q44X | Mornet E, unpublished | perinatal | Q27X/c.662insG | | | na | Nonsense mutation |
| 3 | c.151G > T | A34S | p.A51S | Mumm et al. 2002 | infantile | A34S/T117H | | | + | |
| 3 | c.152G > T | A34V | p.A51V | Taillandier et al. 2001 | infantile | A34V/V442M | | | + | |
| 4 | c.184A > T | M45L | p.M62L | Taillandier et al. 1999 | infantile | M45L/c.1172delC | 27.4 | 1 | + | |
| 4 | c.186A > G | M45V | p.M62V | Spentchian et al. 2003 | childhood | M45V/M45V | | | + | |
| 4 | c.186G > C | M45I | p.M62I | Taillandier et al. 2005 | infantile | M45I/E174K | 0 | 16 | + | |
| 4 | c.187G > C | G46R | p.G63R | Spentchian et al. 2003 | infantile | G46R/G46R | | | + | |
| 4 | c.188G > T | G46V | p.G63V | Lia-Baldini et al. 2001 | infantile | G46V/N | 0.8 | 3 | + | |
| 4 | c.203C > T | T51M | p.T68M | Orimo et al. 2002 | childhood | T51M/A160T | 5.2 | 4 | + | |
| 4 | c.211C > T | R54C | p.R71C | Henthorn et al. 1992 | infantile | R54C/D277A | 0 | 17 | + | |
| 4 | c.211C > A | R54S | p.R71S | Orimo et al. 2002 | childhood | R54S/? | 2.9 | 4 | + | |
| 4 | c.212G > C | R54P | p.R71P | Henthorn et al. 1992 | perinatal | R54P/Q190P | | | + | |
| 4 | c.212G > A | R54H | p.R71H | Taillandier et al. 2001 | infantile | A23V/R54H | | | + | |
| 4 | c.219T > C | I55T | p.I72T | Versailles lab October 2004 | odonto | I55T/N | | | − | |
| 4 | c.223G > A | G58S | p.G75S | Mornet et al. 1998 | infantile | S-1F/G58S | 3.5 | 1 | + | |
| 4 | c.227A > G | Q59R | p.Q76R | Mornet et al. 2001 | infantile | Q59R/T117N | | | − | |
| IVS4 | c.298-2A > G | | | Taillandier et al. 2000 | perinatal | c.298-2A > G/c.997 + 3A > C | | | na | This mutation affects splicing and not coding sequence |
| 5 | c.299C > T | T83M | p.T83M/E174K | Mornet 2001 | infantile | T83M/E174K | | | + | |
| 5 | c.303_311del | N85_N87del | p.N102_N104del | Versailles lab July 2007 | perinatal | c.303_311del/G474R | 0.4 | unp. | na | Deletion |
| 5 | c.323C > T | P91L | p.P108L | Herasse et al. 2003 | odonto | P91L/N | | | − | |
| 5 | c.331G > A | A94T | p.A111T | Goseki-Sone et al. 1998 | odonto | A94T/? | | | + | |
| 5 | c.334G > A | G95S | p.G112S | Witters et al. 2004 | infantile | G95S/R374C | | | − | |
| 5 | c.340G > A | A97T | p.A114T | Mumm et al. 2001 | infantile | A97T/D277A | | | + | |
| 5 | c.341C > G | A97G | p.A114G | Draguet et al. 2004 | perinatal | A97G + c.348_349insACCGTC/G309R | | | + | |
| 5 | c.348_349insACCGTC | | | Draguet et al. 2004 | perinatal | A97G + c.348_349insACCGTC/G309R | | | na | Two missense mutations and insertion |
| 5 | c.346G > T | A99S | p.A116S | Versailles lab July 2007 | adult | A99S/N400S | | | + | |
| 5 | c.346G > A | A99T | p.A116T | Hu et al. 2000 | adult | A99T/N | 0.8 | 3 | + | |
| 5 | c.358G > A | G103R | p.G120R | Mornet et al. 1998 | perinatal | G103R/648 + 1G > A | | | + | |

TABLE 1-continued

Pathogenic mutations for human TNALP*
Total number of mutations 188

| | | Amino acid change | | | | | | |
|---|---|---|---|---|---|---|---|---|
| Exon | Base change | Non-standardized nomenclature | Standardized nomenclature | Reference | Clinical form in patient | Genotype of patient | % WT | ref. | E. coli | |
| 5 | c.368C > A | A106D | p.A123D | Spentchian et al. 2006 | perinatal | A106D/S249_H250del | | | − |
| 5 | c.382G > A | V111M | p.V128M | Mumm et al. 2002 | perinatal | V111M/R206W | | | − |
| 5 | c.385G > A | G112R | p.G129R | Mornet et al. 1998 | perinatal | G112R/G474R | | | + |
| 5 | c.388_391delGTAA | | | Spentchian et al. 2003 | perinatal | E294K/388_391delGTAA | | | na | Frameshift mutation |
| 5 | c.389delT | | | Spentchian et al. 2003 | perinatal | c.389delT/c.389delT | | | na | Frameshift mutation |
| 5 | c.392delG | | | Mumm et al. 2002 | perinatal/infant | c.392delG/A331T | | | na | Frameshift mutation |
| 5 | c.394G > A | A115T | p.A132T | Versailles lab July 2006 | adult | A115T/E174K | 16.9 | | − |
| 5 | c.395C > T | A115V | p.A132V | Watanabe et al. 2001 | adult | A115V/? | | 14 | − |
| 5 | c.400_401AC > CA | T117H | p.T134H | Mumm et al. 2002 | perinatal | T117H/F310del | | | − |
| 5 | c.401C > A | T117N | p.T134N | Taillandier et al. 2000 | perinatal | T117N/T117N | 20.5 | 5 | − |
| 5 | c.406C > T | R119C | p.R136C | Versailles lab October 2003 | odonto | R119C/R119H | | | − |
| 5 | c.407G > A | R119H | p.R136H | Taillandier et al. 1999 | infantile | R119H/G145V | 33.4 | 1 | − |
| 5 | c.442A > G | T131A | p.T148A | Michigami et al. 2005 | perinatal | T131A/? | | | − |
| 5 | c.443C > T | T131I | p.T148I | Spentchian et al. 2003 | infantile | T131I/G145S | | | − |
| 5 | c.480delT | | | Versailles lab. January 2008 | perinatal | c.480delT/R206W | | | na | deletion |
| 6 | c.484G > A | G145S | p.G162S | Taillandier et al. 1999 | infantile | T131I/G145S | 1.3 | 1 | + |
| 6 | c.485G > T | G145V | p.G162V | Taillandier et al. 1999 | infantile | R119H/G145V | 0 | | + |
| 6 | c.500C > T | T150M | p.T167M | Versailles lab October 2003 | infantile | T150M/E174K | 0 | 13 | + |
| 6 | c.508A > G | N153D | p.N170D | Mornet et al. 1998 | perinatal | N153D/N153D | 2.1 | 1 | − |
| 6 | c.511C > T | H154Y | p.H171Y | Taillandier et al. 1999 | infantile | H154Y/E174K | | | − |
| 6 | c.512A > G | H154R | p.H171R | Mornet E, unPublished | adult | H154R/E174K | | | − |
| 6 | c.526G > A | A159T | p.A176T | Taillandier et al. 2000 | childhood | A159T/R229S | 45.4 | 5 | + |
| 6 | c.529G > A | A160T | p.A177T | Goseki-Sone et al. 1998 | adult | A160T/F310L | 83.8 | 4 | + |
| 6 | c.535G > A | A162T | p.A179T | Weiss et al. 1988 | perinatal | A162T/A162T | 18 | 6 | + |
| 6 | c.542C > T | S164L | p.S181L | Lia-Baldini et al. 2001 | infantile | S164L/del(ex12) | 1.3 | 3 | − |
| 6 | c.544delG | | | Taillandier et al. 1999 | perinatal | G232V/544delG | | | na | Frameshift mutation |
| 6 | c.550C > T | R167W | p.R184W | Mornet et al. 1998 | perinatal | R167W/W253X | 0.6 | 3 | + |
| 6 | c.567C > A | D172E | p.D189E | Spentchian et al. 2003 | perinatal | D172E/D172E | | | − |
| 6 | c.568_570delAAC | N173del | p.N190del | Michigami et al. 2005 | perinatal | c.1559delT/N173del | 88.0 | 1 | − | Deletion of 1 a.a. |
| 6 | c.571G > A | E174K | p.E191K | Henthorn et al. 1992 | infantile | E174K/D361V | | | − |
| 6 | c.572A > G | E174G | p.E191G | Taillandier et al. 2001 | odonto | E174G/c.1559delT | | | − |
| 6 | c.575T > C | M175T | p.M192T | Versailles lab July 2007 | infantile | M175T/E294K | | | − |
| 6 | c.577C > G | P176A | p.P193A | Mumm et al. 2002 | adult | A97T/P176A | | | + |
| 6 | c.602G > A | C184Y | p.C201Y | Taillandier et al. 1999 | perinatal | c.-195C > T/C184Y | | | − |
| 6 | c.609C > G | D186E | p.D203E | Versailles lab October 2004 | perinatal | D186E/D186E | | | − |
| 6 | c.620A > C | Q190P | p.Q207P | Henthorn et al. 1992 | infantile | R54P/Q190P | | | + |
| 6 | c.631A > G | N194D | p.N211D | Taillandier et al. 2001 | infantile | A99T/N194D | | | + |
| 6 | c.634A > T | I195F | p.I212F | Souka et al. 2002 | perinatal | I195F/E337D | | | − |

TABLE 1-continued

Pathogenic mutations for human TNALP*
Total number of mutations 188

| Exon | Base change | Amino acid change - Non-standardized nomenclature | Amino acid change - Standardized nomenclature | Reference | Clinical form in patient | Genotype of patient | % WT | ref. | E. coli | |
|---|---|---|---|---|---|---|---|---|---|---|
| IVS6 | c.648 + 1G > T | | | Brun-Heath et al. 2005 | perinatal | c.648 + 1G > T/ D277A | | | | Affects splicing |
| IVS6 | c.648 + 1G > A | | | Mornet et al. 1998 | perinatal | G103R/c.648 + 1G > A | | | na | Affects splicing |
| IVS6 | c.649-1_3delinsAA | | | Versailles lab July 2006 | | c.649-1_3delinsAA/c.649-1_3delinsAA | | | | Frameshift mutation |
| 7 | c.653T > C | I201T | p.I218T | Utsch et al., 2005, contact | perinatal | I201T/R374C | 3.7 | unp. | − | |
| 7 | 659G > T | G203V | p.G220V | Taillandier et al. 2001 | odonto | E174K/G203V | | | + | |
| 7 | 659G > C | G203A | p.G220A | Spentchian et al. 2003 | perinatal | G203A/G203A | | | + | |
| 7 | 662insG | | | Mornet E, unpublished | perinatal | Q27X/662insG | | | na | Frameshift mutation |
| 7 | c.662delG | | | Spentchian et al. 2003 | perinatal | R255L/c.662delG | | | na | Frameshift mutation |
| 7 | c.667G > T | G204V | p.G221V | Versailles lab October 2004 | perinatal | G204V/M338T | | | + | |
| 7 | c.667C > T | R206W | p.R223W | Mornet et al. 1998 | perinatal | R206W/? | 2.8 | 3 | − | |
| 7 | c.668G > A | R206Q | p.R223Q | Mumm et al. 2002 | infantile | R206Q/deletion | | | − | |
| 7 | c.670A > G | K207E | p.K224E | Mochizuki et al. 2000 | infantile | K207E/G409C | 43 | 15 | + | |
| 7 | c.677T > C | M209T | p.M226T | Baumgartner-Sigl et al. 2007 | adult | M209T/T354I | | | − | |
| 7 | c.704A > G | E218G | p.E235G | Taillandier et al. 2001 | childhood | E218G/A382S | 3.6 | 7 | + | |
| 7 | c.738G > T | R229S | p.R246S | Taillandier et al. 2000 | perinatal | A159T/R229S | 4.4 | 5 | − | |
| 7 | c.746G > T | G232V | p.G249V | Fedde et al. 1996 | perinatal | G232V/N | 34.5 | 3 | + | |
| 7 | c.971A > G | K247R | p.K264R | Versailles lab January 2007 | perinatal | K247R/D361V | | | − | |
| 8 | c.797_802del | S249_H250del | p.S266_H267del | Spentchian et al. 2006 | perinatal | A106D/S249_H250del | | | | Deletion of 2 a.a. |
| 8 | c.809G > A | W253X | p.W270X | Mornet et al. 1998 | perinatal | R167W/W253X | | | na | Nonsense mutation |
| 8 | c.814C > T | R255C | p.R272C | Spentchian et al. 2006 | perinatal | R255C/T117H | | | − | |
| 8 | c.815G > T | R255L | p.R272L | Spentchian et al. 2003 | perinatal | R255L/c.662delG | | | − | |
| 8 | c.815G > A | R255H | p.R272H | Brun-Heath et al. 2005 | infantile | R255H/R255H | 6.8 | 16 | − | |
| 8 | c.824T > C | L258P | p.L275P | Orimo et al. 2002 | childhood | L258P/A160T | 3.3 | 4 | − | |
| 8 | c.853_854insGATC | Y268X | p.Y285X | Michigami et al. 2005 | perinatal | c1559delT/Y268X | | | na | Nonsense mutation |
| IVS8 | c.862 + 5G > A | | | Taillandier et al. 1999 | infantile | c.862 + 5G > A/c.862 + 5G > A | | | na | Affects splicing |
| 9 | c.865C > T | L272F | p.L289F | Sugimoto et al. 1998 | infantile | L272F/? | 50 | 8 | − | |
| 9 | c.871G > A | E274K | p.E291K | Mornet et al. 1998 | infantile | E174K/E274K | 8.3 | 1 | − | |
| 9 | c.871G > T | E274X | p.E291X | Taillandier et al. 2000 | perinatal | A94T/E274X | | | − | Nonsense mutation |
| 9 | c.874C > A | P275T | p.P292T | Brun-Heath et al. 2005 | infantile | P275T/A16V | 4.0 | 16 | + | |
| 9 | c.876_881delAGGGGA | G276_D277del | p.G276_D277del | Spentchian et al. 2003 | perinatal | G276_D277del/c.962delG | | | na | |
| 9 | c.880G > T | D277Y | p.D277Y | Taillandier et al. 2001 | infantile | A159T/D277Y | | | − | |
| 9 | c.881A > C | D277A | p.D294A | Henthorn et al. 1992 | infantile | R54C/D277A | 0 | 17 | − | |
| 9 | c.883A > G | M278V | p.M295V | Mornet et al. 2001 | childhood | E174K/M278V | | | − | |
| 9 | c.884T > C | M278T | p.M295T | Brun-Heath et al. 2005 | perinatal | M278T/R206W | 8.5 | 16 | − | |
| 9 | c.885G > A | M278I | p.M295I | Michigami et al. 2005 | perinatal | M278I/c.1559delT | | | − | |
| 9 | c.889T > G | Y280D | p.Y297D | Brun-Heath et al. 2005 | childhood | R119H/Y280D | 1.3 | 16 | − | |

TABLE 1-continued

Pathogenic mutations for human TNALP*
Total number of mutations 188

| Exon | Base change | Amino acid change Non-standardized nomenclature | Amino acid change Standardized nomenclature | Reference | Clinical form in patient | Genotype of patient | % WT | ref. | E. coli | |
|---|---|---|---|---|---|---|---|---|---|---|
| 9 | c.892G > A | E281K | p.E298K | Orimo et al. 1994 | infantile | E281K/1559delT | 9.7 | 15 | − | |
| 9 | c.896T > C | L282P | p.L299P | Versailles lab October 2003 | infantile | L282P/L282P | 0 | 12 | − | |
| 9 | c.917A > T | D289V | p.D306V | Taillandier et al. 1999 | infantile | D289V/D289V | | | − | |
| 9 | c.919C > T | P290S | p.P307S | Versailles lab October 2004 | childhood | P290S/M450T | | | + | |
| 9 | c.920C > T | P290L | p.P307L | Versailles lab July 2006 | perinatal | P290L/S164L | | | | |
| 9 | c.928_929delTC | | | Brun-Heath et al. 2005 | perinatal | T394A/c.928_929delTC | | | − | Frameshift mutation |
| 9 | c.931G > A | E294K | p.E311K | Spentchian et al. 2003 | perinatal | E294K/c.388_391delGTAA | | | na | Frameshift mutation |
| 9 | c.962delG | | | Spentchian et al. 2003 | perinatal | G276_D277del/c.962delG | | | + | Amino acid deletion |
| 9 | c.976G > C | G309R | p.G326R | Litmanovitz et al. 2002 | perinatal | G309R/E274K | | | + | |
| 9 | c.981_983delCTT | F310del | p.F327del | Orimo et al. 1997 | infantile | F310del/c.1559delT | ~10 | 15 | + | |
| 9 | c.979T > G | F310C | p.F327C | Mornet et al. 2001 | perinatal | T117N/F310C | | | + | |
| 9 | c.979_980TT > GG | F310G | p.F327G | Taillandier et al. 2001 | adult | E174K/F310G | | | + | |
| 9 | c.979T > C | F310L | p.F327L | Ozono et al. 1996 | infantile | F310L/G439R | 72 | 9 | + | |
| 9 | c.982T > A | F311L | p.F328L | Michigami et al. 2005 | perinatal non-lethal | F311L/T83M | ~10 | 15 | + | |
| IVS9 | c.997 + 2T > A | | | Taillandier et al. 2000 | perinatal | c.997 + 2T > A/C472S | | | na | Affects splicing |
| IVS9 | c.997 + 2T > G | | | Brun-Heath et al. 2005 | perinatal | c.997 + 2T > G/c.997 + 2T > G | | | na | Affects splicing |
| IVS9 | c.997 + 3A > C | | | Mornet et al. 1998 | perinatal | c.997 + 3A > C/c.997 + 3A > C | | | na | Affects splicing |
| IVS9 | c.998-1G > T | | | Taillandier et al. 2001 | perinatal | E174K/c.998-1G > T | | | | |
| 10 | c.1001G > A | G317D | p.G334D | Greenberg et al. 1993 | perinatal | G317D/G317D | 0 | 10 | − | |
| 10 | c.1015G > A | G322R | p.G339R | Mumm et al. 2002 | perinatal | G322R/A159T | | | − | |
| 10 | c.1016G > A | G322E | p.G339E | Versailles lab October 2004 | infantile | G322E/V111M | | | − | |
| 10 | c.1042G > A | A331T | p.A348T | Taillandier et al. 2000 | perinatal | E174K/A331T | 33.2 | 5 | − | |
| 10 | c.1044_1055del | L332_A335del | p.L349_A352del | Spentchian et al. 2006 | perinatal | L332_A335del/G474R | | | | Deletion of 4 a.a. |
| 10 | c.1062G > C | E337D | p.E354D | Souka et al. 2002 | perinatal | I195F/E337D | | | + | |
| 10 | c.1064A > C | M338T | p.M355T | Versailles lab October 2004 | perinatal | G204V/M338T | | | − | |
| 10 | c.1065G > A | M338I | p.M355I | Versailles lab. January 2008 | infantile | M338I/R374C | | | − | |
| 10 | c.1101_1103delCTC | S351del | p.S368del | Versailles lab October 2004 | perinatal | c.1101_1103delCTC/T372I | | | | Deletion of 1 a.a. |
| 10 | c.1112C > T | T354I | p.T371I | Baumgartner-Sigl et al. 2007 | infantile | M209T/T354I | | | − | |
| 10 | c.1120G > A | V357M | p.V374M | Versailles lab October 2004 | adult | V357M/E281K | | | + | |
| 10 | c.1130C > T | A360V | p.A377V | Mornet et al. 2001 | perinatal | A360V/A360V | | | + | |
| 10 | c.1133A > T | D361V | p.D378V | Henthorn et al. 1992 | infantile | E174K/D361V | 1.2 | 3 | + | |
| 10 | c.1142A > G | H364R | p.H381R | Taillandier et al. 2000 | infantile | A23V/H364R | | | + | |
| 10 | c.1144G > A | V365I | p.V382I | Goseki-Sone et al. 1998 | childhood | F310L/V365I | 0 | 11 | + | |

TABLE 1-continued

Pathogenic mutations for human TNALP*
Total number of mutations 188

| Exon | Base change | Amino acid change — Non-standardized nomenclature | Amino acid change — Standardized nomenclature | Reference | Clinical form in patient | Genotype of patient | % WT | ref. | E. coli | |
|---|---|---|---|---|---|---|---|---|---|---|
| 10 | c.1166C > T | T372I | p.T389I | Versailles lab October 2004 | perinatal | T372I/S351del | 10.3 | 1 | − | |
| 10 | c.1171C > T | R374C | p.R391C | Zurutuza et al. 1999 | childhood | E174K/R374C | | 14 | − | |
| 10 | c.1172G > A | R374H | p.R391H | Orimo et al. 2002 | infantile | R374H/? | 3.7 | | − | |
| 10 | c.1172delC | | | Versailles lab. January 1999 | perinatal | M45L/c.1172delC | | | na | Frameshift mutation |
| 10 | c.1175G > C | G375A | p.G392A | Versailles lab. January 2008 | perinatal | G375A/R119C | | | − | |
| 10 | c.1182T > C | I378T | p.I395T | Versailles lab July 2006 | perinatal | I378T/E174K | | | − | |
| 10 | c.1195G > T | A382S | p.A399S | Taillandier et al. 2001 | adult | E218G/A382S | | | − | |
| 10 | c.1196C > T | A382V | p.A399V | Spentchian et al. 2006 | adult | A382V/A16V | | | − | |
| 10 | c.1199C > T | P383L | p.P400L | Spentchian et al. 2006 | perinatal | P383L/P383L | | | + | |
| 11 | c.1214_1215delCA | | | Versailles lab July 2006 | adult | c.1214_1215delCA/E174K | | | − | |
| 11 | c.1216_1219delGACA | | | Brun-Heath et al. 2005 | perinatal | c.1216_1219delGACA/? | | | na | Frameshift mutation |
| 11 | c.1217A > G | D389G | p.D406G | Taillandier et al. 2000 | odonto. | D389G/R433H | 14.9 | 5 | + | |
| 11 | c.1228T > C | F393L | p.F410L | Versailles lab October 2004 | infantile | F393L/E174K | | 16 | − | |
| 11 | c.1231A > G | T394A | p.T411A | Brun-Heath et al. 2005 | perinatal | T394A/c.926_927delTC | 0.3 | | + | |
| 11 | c.1240C > A | L397M | p.L414M | Mumm et al. 2002 | perinatal | L397M/D277A | | | − | |
| 11 | c.1250A > G | N400S | p.N417S | Sergi et al. 2001 | adult | N400S/c.648 + 1G > A | 3 | unp. | + | |
| 11 | c.1256delC | | | Versailles lab July 2006 | perinatal | c.1256delC/? | | | na | Frameshift mutation |
| 11 | c.1258G > A | G403S | p.G420S | Glaser et al. 2004 | perinatal | G403S/G403S | 0.4 | unp. | − | |
| 11 | c.1268T > C | V406A | p.V423A | Taillandier et al. 2001 | perinatal | A99T/V406A | 15.7 | 2 | − | |
| 11 | c.1270G > A | V407M | p.V424M | Versailles lab January 2007 | adult | V407M/V407M | | 15 | − | |
| 11 | c.1276G > T | G409C | p.G426C | Mochizuki et al. 2000 | infantile | K207A/G409C | 18.5 | | − | |
| 11 | c.1277G > A | G409D | p.G426D | Mumm et al. 2002 | childhood | G409D/E174K | | | − | |
| 11 | c.1282C > T | R411X | p.R428X | Taillandier et al. 1999 | perinatal | R411X/R411X | | | na | Nonsense mutation |
| 11 | c.1283G > C | R411P | p.R428P | Spentchian et al. 2006 | perinatal | R411P/c.997 + 2T > A | | | − | |
| 11 | c.1285G > A | E412K | p.E429K | Versailles lab July 2006 | perinatal | E412K/? | | | | |
| 11 | c.1306T > C | Y419H | p.Y436H | Henthorn et al. 1992 | childhood | A16V/Y419H | 2.1 | 1 | − | |
| 12 | c.1333T > C | S428P | p.S445P | Mornet et al. 1998 | infantile | S428P/? | | | − | |
| 12 | c.1349G > A | R433H | p.R450H | Taillandier et al. 2000 | odonto. | D389G/R433H | | | − | |
| 12 | c.1348G > T | R433C | p.R450C | Mornet et al. 1998 | infantile | R433C/R433C | 4.0 | 1 | − | |
| 12 | c.1354G > A | E435K | p.E452K | Spentchian et al. 2003 | perinatal | A94T/E435K | | | + | |
| 12 | c.1361G > A | H437R | p.H454R | Versailles lab October 2003 | childhood | E174K/H437R | | | − | |
| 12 | c.1363G > A | G438S | p.G455S | Draguet et al. 2004 | adult | G438S/G474R | | | + | |
| 12 | c.1364G > A | G438D | p.G455D | Versailles lab January 2007 | perinatal | G438D/G438D | | | − | |
| 12 | c.1366G > T | G439W | p.G456W | Versailles lab October 2003 | childhood | G439W/? | | | + | |
| 12 | c.1366G > A | G439R | p.G456R | Ozono et al. 1996 | infantile | G439R/? | 1.5 | unp. | + | |
| 12 | c.1375G > T | V442M | p.V459M | Taillandier et al. 2000 | perinatal | A34V/V442M | | | − | |
| 12 | c.1375G > A | V442L | p.V459L | Versailles lab October 2004 | perinatal | V442L/E435K | | | + | |
| 12 | c.1396C > T | P449L | p.P466L | Versailles lab October 2003 | infantile | P449L/? | | | + | |
| 12 | c.1400T > C | M450T | p.M467T | Versailles lab October 2004 | infantile | M450T/P290S | | | + | |
| 12 | c.1402G > A | A451T | p.A468T | Spentchian et al. 2003 | perinatal | A451T/A451T | | | + | |

TABLE 1-continued

Pathogenic mutations for human TNALP*
Total number of mutations 188

| Exon | Base change | Amino acid change - Non-standardized nomenclature | Amino acid change - Standardized nomenclature | Reference | Clinical form in patient | Genotype of patient | % WT | ref. | E. coli | |
|---|---|---|---|---|---|---|---|---|---|---|
| 12 | c.1417G > A | G456S | p.G473S | Mornet et al. 1998 | perinatal | A23V/G456S | | | + | |
| 12 | c.1426G > A | E459K | p.E476K | Taillandier et al. 1999 | perinatal | A94T/E459K | | | + | |
| 12 | c.1427A > G | E459G | p.E476G | Mornet et al. 2001 | perinatal | E459G/E459G | | | + | |
| 12 | c.1433A > T | N461I | p.N478I | Taillandier et al. 2000 | childhood | N461I/N | 1.1 | 3 | − | |
| 12 | c.1444_1445insC | | | Brun-Heath et al. 2005 | perinatal | c.1444_1445insC/G317D | | | | Frameshift mutation |
| 12 | c.1456G > C | C472S | p.C489S | Taillandier et al. 2000 | perinatal | C472S/c.997 + 2T > A | 9.4 | 5 | − | |
| 12 | c.1468A > T | I473F | p.I490F | Lia-Baldini et al. 2001 | adult | I473F/? | 37.1 | 3 | − | |
| 12 | c.1471G > A | G474R | p.G491R | Mornet et al. 1998 | perinatal | G112R/G474R | | | − | |
| 12 | c.1471delG | | | Brun-Heath et al. 2005 | odonto | c.1471delG/R119H | | | | Frameshift mutation |
| 12 | c.1559delT | | | Orimo et al. 1994 | infantile | E281K/c.1559delT | 28 | 18 | na | Frameshift mutation |
| Large deletions | | | | | | | | | | |
| deletion of exons 3-5 | | | | Spentchian et al. 2006 | perinatal | homozygote | | | | |
| deletion of exon 12 (3' part) | | | | Spentchian et al. 2006 | infantile | compound heterozygote with S164L | | | | |

*In the column labeled "Non-standardized nomenclature" under "Amino acid change," the position of the mutation is provided with respect to mature human TNALP lacking the N-terminal signal sequence. In the column labeled "Standardized nomenclature" under "Amino acid change," the position is provided with respect to full length human TNALP having the 17-amino acid N-terminal signal sequence (SEQ ID NO: 1208).

In some embodiments, the sALP polypeptides of the invention do not include any of the mutations provided in Table 1. In particular, the sALP polypeptides of the invention, using the numbering of the consensus sequence of SEQ ID NO: 1218 (FIG. 10), the amino acid at position 22 is not a phenylalanine residue; the amino acid at position 33 (position 11 in the sequence without signal peptide) is not a cysteine residue; the amino acid at position 38 (position 16 in the sequence without signal peptide) is not a valine residue; the amino acid at position 42 (position 20 in the sequence without signal peptide) is not a proline residue; the amino acid at position 45 (position 23 in the sequence without signal peptide) is not a valine residue; the amino acid residue at position 56 (position 34 in the sequence without signal peptide) is not a serine or a valine residue; the amino acid residue at position 67 (position 45 in the sequence without signal peptide) is not a leucine, an isoleucine or a valine residue; the amino acid residue at position 68 (position 46 in the sequence without signal peptide) is not a valine residue; the amino acid residue at position 73 (position 51 in the sequence without signal peptide) is not a methionine residue; the amino acid residue at position 76 (position 54 in the sequence without signal peptide) is not a cysteine, a serine, a proline or a histidine residue; the amino acid residue at position 77 (position 55 in the sequence without signal peptide) is not a threonine residue; the amino acid residue at position 80 (position 58 in the sequence without signal peptide) is not a serine residue; the amino acid residue at position 81 (position 59 in the sequence without signal peptide) is not an asparagine residue; the amino acid residue at position 105 (position 83 in the sequence without signal peptide) is not a methionine residue; the amino acid residue at position 113 (position 89 in the sequence without signal peptide) is not a leucine residue; the amino acid residue at position 116 (position 94 in the sequence without signal peptide) is not a threonine residue; the amino acid residue at position 117 (position 95 in the sequence without signal peptide) is not a serine residue; the amino acid residue at position 119 (position 97 in the sequence without signal peptide) is not a glycine residue; the amino acid residue at position 121 (position 99 in the sequence without signal peptide) is not a serine or a threonine residue; the amino acid residue at position 125 (position 103 in the sequence without signal peptide) is not an arginine residue; the amino acid residue at position 128 (position 106 in the sequence without signal peptide) is not a aspartic acid residue; the amino acid residue at position 133 (position 111 in the sequence without signal peptide) is not a methionine residue; the amino acid residue at position 134 (position 112 in the sequence without signal peptide) is not an arginine residue; the amino acid residue at position 137 (position 115 in the sequence without signal peptide) is not a threonine or a valine residue; the amino acid residue at position 139 (position 117 in the sequence without signal peptide) is not a histidine or an asparagine residue; the amino acid residue at position 141 (position 119 in the sequence without signal peptide) is not a histidine residue; the amino acid residue at position 153 (position 131 in the sequence without signal peptide) is not an alanine or an isoleucine residue; the amino acid residue at position 167 (position 145 in the sequence without signal peptide) is not a serine or a valine residue; the amino acid residue at position 172 (position 150 in the sequence without signal peptide) is not a methionine residue; the amino acid residue at position 175 (position 153 in the sequence without signal peptide) is not an aspartic acid residue; the amino acid residue at position 176 (position 154 in the sequence without signal peptide) is not a tyrosine or an arginine residue; the amino acid residue at position 181 (position 159 in the sequence without signal peptide) is not a threonine residue; the amino acid residue at position 182 (position 160 in the sequence without signal peptide) is not a threonine residue; the amino acid residue at position 184 (position 162 in the sequence without signal peptide) is not a threonine residue; the amino acid residue at position 186 (position 164 in the sequence without signal peptide) is not a leucine residue; the amino acid residue at position 189 (position 167 in the sequence without signal peptide) is not a tryptophan residue; the amino acid residue at position 194 (position 172 in the sequence without signal peptide) is not a glutamate residue; the amino acid residue at position 196 (position 174 in the sequence without signal peptide) is not a lysine or a glycine residue; the amino acid residue at position 197 (position 175 in the sequence without signal peptide) is not a threonine residue; the amino acid residue at position 198 (position 176 in the sequence without signal peptide) is not an alanine residue; the amino acid residue at position 206 (position 184 in the sequence without signal peptide) is not a tyrosine residue; the amino acid residue at position 208 (position 186 in the sequence without signal peptide) is not a glutamate residue; the amino acid residue at position 207 (position 190 in the sequence without signal peptide) is not a proline residue; the amino acid residue at position 216 (position 194 in the sequence without signal peptide) is not a aspartic acid residue; the amino acid residue at position 217 (position 195 in the sequence without signal peptide) is not a phenylalanine residue; the amino acid residue at position 223 (position 201 in the sequence without signal peptide) is not a threonine residue; the amino acid residue at position 225 (position 203 in the sequence without signal peptide) is not a valine or an alanine residue; the amino acid residue at position 226 (position 204 in the sequence without signal peptide) is not a valine residue; the amino acid residue at position 228 (position 206 in the sequence without signal peptide) is not a tryptophan or a glutamine residue; the amino acid residue at position 229 (position 207 in the sequence without signal peptide) is not a glutamate residue; the amino acid residue at position 231 (position 209 in the sequence without signal peptide) is not a threonine residue; the amino acid residue at position 240 (position 218 in the sequence without signal peptide) is not a glycine residue; the amino acid residue at position 251 (position 229 in the sequence without signal peptide) is not a serine residue; the amino acid residue at position 254 (position 232 in the sequence without signal peptide) is not a valine residue; the amino acid residue at position 269 (position 247 in the sequence without signal peptide) is not an arginine residue; the amino acid residue at position 277 (position 255 in the sequence without signal peptide) is not a cysteine, a leucine or a histidine residue; the amino acid residue at position 280 (position 258 in the sequence without signal peptide) is not a proline residue; the amino acid residue at position 295 (position 273 in the sequence without signal peptide) is not a phenylalanine residue; the amino acid residue at position 297 (position 275 in the sequence without signal peptide) is not a lysine residue; the amino acid residue at position 298 (position 276 in the sequence without signal peptide) is not a threonine residue; the amino acid residue at position 300 (position 278 in the sequence without signal peptide) is not a tyrosine or an alanine residue; the amino acid residue at position 301 (position 279 in the sequence without signal peptide) is not a valine, a threonine or an isoleucine residue; the amino acid residue at position 303 (position 281 in the sequence without signal peptide) is not an aspirate residue; the amino acid residue at position 304 (position 282 in the sequence without signal peptide) is not a lysine residue; the amino acid residue at position 305 (position 283 in the sequence without signal peptide) is not a proline residue; the amino acid residue at position 312 (position 290 in the sequence without signal peptide) is not a valine residue; the amino acid residue at position 313 (position 291 in the sequence without signal peptide) is not a serine or a leucine residue; the amino acid residue at position 317 (position 295 in the sequence without signal peptide) is not a lysine residue; the amino acid residue at position 332 (position 310 in the sequence without signal peptide) is not an arginine residue; the amino acid residue at position 333 (position 311 in the sequence without signal peptide) is not a cysteine, a glycine or a leucine residue; the amino acid residue at position 334 (position 312 in the sequence without signal peptide) is not a leucine residue; the amino acid residue at position 340 (position 318 in the sequence without signal peptide) is not an aspartic acid residue; the amino acid residue at position 345 (position 323 in the sequence without signal peptide) is not an arginine or a glutamate residue; the amino acid residue at position 354 (position 332 in the sequence without signal peptide) is not a threonine residue; the amino acid residue at position 360 (position 338 in the sequence without signal peptide) is not an aspartic acid residue; the amino acid residue at position 361 (position 339 in the sequence without signal peptide) is not a threonine or an isoleucine residue; the amino acid residue at position 377 (position 355 in the sequence without signal peptide) is not a leucine residue; the amino acid residue at position 380 (position 358 in the sequence without signal peptide) is not a methionine residue; the amino acid residue at position 383 (position 361 in the sequence without signal peptide) is not a valine residue; the amino acid residue at position 384 (position 362 in the sequence without signal peptide) is not a valine residue; the amino acid residue at position 387 (position 365 in the sequence without signal peptide) is not an arginine residue; the amino acid residue at position 388 (position 366 in the sequence without signal peptide) is not a leucine residue; the amino acid residue at position 395 (position 373 in the sequence without signal peptide) is not a leucine residue; the amino acid residue at position 397 (position 375 in the sequence without signal peptide) is not a cysteine or a histidine residue; the amino acid residue at position 398 (position 376 in the sequence without signal peptide) is not an alanine residue; the amino acid residue at position 401 (position 379 in the sequence without signal peptide) is not a threonine residue; the amino acid residue at position 405 (position 383 in the sequence without signal peptide) is not a serine or a valine residue; the amino acid residue at position 406 (position 384 in the sequence without signal peptide) is not a leucine residue; the amino acid residue at position 412 (position 390 in the sequence without signal peptide) is not a glycine residue; the amino acid residue at position 416 (position 394 in the sequence without signal peptide) is not a leucine residue; the amino acid residue at position 417 (position 395 in the sequence without signal peptide) is not an alanine residue; the amino acid residue at position 420 (position 398 in the sequence without signal peptide) is not a methionine residue; the amino acid residue at position 423 (position 401 in the sequence without signal peptide) is not a serine residue; the amino acid residue at position 426 (position 404 in the sequence without signal peptide) is not a serine residue; the amino acid residue at position 429 (position 407 in the sequence without signal peptide) is not an alanine residue; the amino acid residue at position 430 (position 408 in the sequence without signal peptide) is not a methionine residue; the amino acid residue at position 432 (position 410 in the sequence without signal peptide) is not a cysteine or an aspartic acid residue; amino acid residue at position 434 (position 412 in the sequence without signal peptide) is not a proline residue; amino acid residue at position 435 (position 413 in the sequence without signal peptide) is not a lysine residue; amino acid residue at position 442 (position 420 in the sequence without signal peptide) is not a histidine residue; amino acid residue at position 451 (position 429 in the sequence without signal peptide) is not a proline residue; amino acid residue at position 456 (position 434 in the sequence without signal peptide) is not a histidine or a cysteine residue; amino acid residue at position 458 (position 436 in the sequence without signal peptide) is not a lysine residue; amino acid residue at position 460 (position 438 in the sequence without signal peptide) is not an arginine residue; amino acid residue at position 461 (position 439 in the sequence without signal peptide) is not a serine or an aspartic acid residue; amino acid residue at position 462 (position 440 in the sequence without signal peptide) is not a tryptophan or an arginine residue; amino acid residue at position 465 (position 443 in the sequence without signal peptide) is not a methionine or a leucine residue; amino acid residue at position 472 (position 450 in the sequence without signal peptide) is not a leucine residue; amino acid residue at position 473 (position 451 in the sequence without signal peptide) is not a threonine residue; amino acid residue at position 474 (position 452 in the sequence without signal peptide) is not a threonine residue; amino acid residue at position 479 (position 457 in the sequence without signal peptide) is not a serine residue; amino acid residue at position 482 (position 460 in the sequence without signal peptide) is not a lysine or a glycine residue; amino acid residue at position 484 (position 462 in the sequence without signal peptide) is not a leucine residue; amino acid residue at position 495 (position 473 in the sequence without signal peptide) is not a serine residue; amino acid residue at position 496 (position 474 in the sequence without signal peptide) is not a phenylalanine residue; and amino acid residue at position 497 (position 475 in the sequence without signal peptide) is not an arginine residue.

Also more specifically, when a sTNALP is used in the bone targeted sALPs of the present invention, using the numbering of the human TNALP sequence, the amino acid at position 17 is not a phenylalanine residue; the amino acid at position 28 (position 11 in the sequence without signal peptide) is not a cysteine residue; the amino acid at position 33 (position 16 in the sequence without signal peptide) is not a valine residue; the amino acid at position 37 (position 20 in the sequence without signal peptide) is not a proline residue; the amino acid at position 40 (position 23 in the sequence without signal peptide) is not a valine residue; the amino acid residue at position 51 (position 34 in the sequence without signal peptide) is not a serine or a valine residue; the amino acid residue at position 62 (position 45 in the sequence without signal peptide) is not a leucine, an isoleucine or a valine residue; the amino acid residue at position 63 (position 46 in the sequence without signal peptide) is not a valine residue; the amino acid residue at position 68 (position 51 in the sequence without signal peptide) is not a methionine residue; the amino acid residue at position 71 (position 54 in the sequence without signal peptide) is not a cysteine, a serine, a proline or a histidine residue; the amino acid residue at position 72 (position 55 in the sequence without signal peptide) is not a threonine residue; the amino acid residue at position 75 (position 58 in the sequence without signal peptide) is not a serine residue; the amino acid residue at position 76 (position 59 in the sequence without signal peptide) is not an asparagine residue; the amino acid residue at position 100 (position 83 in the sequence without signal peptide) is not a methionine residue; the amino acid residue at position 108 (position 89 in the sequence without signal peptide) is not a leucine residue; the amino acid residue at position 111 (position 94 in the sequence without signal peptide) is not a threonine residue; the amino acid residue at position 112 (position 95 in the sequence without signal peptide) is not a serine residue; the amino acid residue at position 114 (position 97 in the sequence without signal peptide) is not a glycine residue; the amino acid residue at position 116 (position 99 in the sequence without signal peptide) is not a serine or a threonine residue; the amino acid residue at position 120 (position 103 in the sequence without signal peptide) is not an arginine residue; the amino acid residue at position 123 (position 106 in the sequence without signal peptide) is not a aspartic acid residue; the amino acid residue at position 128 (position 111 in the sequence without signal peptide) is not a methionine residue; the amino acid residue at position 129 (position 112 in the sequence without signal peptide) is not an arginine residue; the amino acid residue at position 132 (position 115 in the sequence without signal peptide) is not a threonine or a valine residue; the amino acid residue at position 134 (position 117 in the sequence without signal peptide) is not a histidine or an asparagine residue; the amino acid residue at position 136 (position 119 in the sequence without signal peptide) is not a histidine residue; the amino acid residue at position 148 (position 131 in the sequence without signal peptide) is not an alanine or an isoleucine residue; the amino acid residue at position 162 (position 145 in the sequence without signal peptide) is not a serine or a valine residue; the amino acid residue at position 167 (position 150 in the sequence without signal peptide) is not a methionine residue; the amino acid residue at position 170 (position 153 in the sequence without signal peptide) is not an aspartic acid residue; the amino acid residue at position 171 (position 154 in the sequence without signal peptide) is not a tyrosine or an arginine residue; the amino acid residue at position 176 (position 159 in the sequence without signal peptide) is not a threonine residue; the amino acid residue at position 177 (position 160 in the sequence without signal peptide) is not a threonine residue; the amino acid residue at position 179 (position 162 in the sequence without signal peptide) is not a threonine residue; the amino acid residue at position 181 (position 164 in the sequence without signal peptide) is not a leucine residue; the amino acid residue at position 184 (position 167 in the sequence without signal peptide) is not a tryptophan residue; the amino acid residue at position 189 (position 172 in the sequence without signal peptide) is not a glutamate residue; the amino acid residue at position 191 (position 174 in the sequence without signal peptide) is not a lysine or a glycine residue; the amino acid residue at position 192 (position 175 in the sequence without signal peptide) is not a threonine residue; the amino acid residue at position 193 (position 176 in the sequence without signal peptide) is not an alanine residue; the amino acid residue at position 201 (position 184 in the sequence without signal peptide) is not a tyrosine residue; the amino acid residue at position 203 (position 186 in the sequence without signal peptide) is not a glutamate residue; the amino acid residue at position 207 (position 190 in the sequence without signal peptide) is not a proline residue; the amino acid residue at position 211 (position 194 in the sequence without signal peptide) is not a aspartic acid residue; the amino acid residue at position 212 (position 195 in the sequence without signal peptide) is not a phenylalanine residue; the amino acid residue at position 218 (position 201 in the sequence without signal peptide) is not a threonine residue; the amino acid residue at position 220 (position 203 in the sequence without signal peptide) is not a valine or an alanine residue; the amino acid residue at position 221 (position 204 in the sequence without signal peptide) is not a valine residue; the amino acid residue at position 223 (position 206 in the sequence without signal peptide) is not a tryptophan or a glutamine residue; the amino acid residue at position 224 (position 207 in the sequence without signal peptide) is not a glutamate residue; the amino acid residue at position 226 (position 209 in the sequence without signal peptide) is not a threonine residue; the amino acid residue at position 235 (position 218 in the sequence without signal peptide) is not a glycine residue; the amino acid residue at position 246 (position 229 in the sequence without signal peptide) is not a serine residue; the amino acid residue at position 249 (position 232 in the sequence without signal peptide) is not a valine residue; the amino acid residue at position 264 (position 247 in the sequence without signal peptide) is not an arginine residue; the amino acid residue at position 272 (position 255 in the sequence without signal peptide) is not a cysteine, a leucine or a histidine residue; the amino acid residue at position 275 (position 258 in the sequence without signal peptide) is not a proline residue; the amino acid residue at position 289 (position 272 in the sequence without signal peptide) is not a phenylalanine residue; the amino acid residue at position 291 (position 274 in the sequence without signal peptide) is not a lysine residue; the amino acid residue at position 292 (position 275 in the sequence without signal peptide) is not a threonine residue; the amino acid residue at position 294 (position 277 in the sequence without signal peptide) is not a tyrosine or an alanine residue; the amino acid residue at position 295 (position 278 in the sequence without signal peptide) is not a valine, a threonine or an isoleucine residue; the amino acid residue at position 297 (position 280 in the sequence without signal peptide) is not an aspirate residue; the amino acid residue at position 298 (position 281 in the sequence without signal peptide) is not a lysine residue; the amino acid residue at position 299 (position 282 in the sequence without signal peptide) is not a proline residue; the amino acid residue at position 306 (position 289 in the sequence without signal peptide) is not a valine residue; the amino acid residue at position 307 (position 290 in the sequence without signal peptide) is not a serine or a leucine residue; the amino acid residue at position 311 (position 294 in the sequence without signal peptide) is not a lysine residue; the amino acid residue at position 326 (position 309 in the sequence without signal peptide) is not an arginine residue; the amino acid residue at position 327 (position 310 in the sequence without signal peptide) is not a cysteine, a glycine or a leucine residue; the amino acid residue at position 328 (position 311 in the sequence without signal peptide) is not a leucine residue; the amino acid residue at position 334 (position 317 in the sequence without signal peptide) is not an aspartic acid residue; the amino acid residue at position 339 (position 322 in the sequence without signal peptide) is not an arginine or a glutamate residue; the amino acid residue at position 348 (position 331 in the sequence without signal peptide) is not a threonine residue; the amino acid residue at position 354 (position 337 in the sequence without signal peptide) is not an aspartic acid residue; the amino acid residue at position 355 (position 338 in the sequence without signal peptide) is not a threonine or an isoleucine residue; the amino acid residue at position 371 (position 354 in the sequence without signal peptide) is not a leucine residue; the amino acid residue at position 374 (position 357 in the sequence without signal peptide) is not a methionine residue; the amino acid residue at position 377 (position 360 in the sequence without signal peptide) is not a valine residue; the amino acid residue at position 378 (position 361 in the sequence without signal peptide) is not a valine residue; the amino acid residue at position 381 (position 364 in the sequence without signal peptide) is not an arginine residue; the amino acid residue at position 382 (position 365 in the sequence without signal peptide) is not a leucine residue; the amino acid residue at position 389 (position 372 in the sequence without signal peptide) is not a leucine residue; the amino acid residue at position 391 (position 374 in the sequence without signal peptide) is not a cysteine or a histidine residue; the amino acid residue at position 392 (position 375 in the sequence without signal peptide) is not an alanine residue; the amino acid residue at position 395 (position 378 in the sequence without signal peptide) is not a threonine residue; the amino acid residue at position 399 (position 382 in the sequence without signal peptide) is not a serine or a valine residue; the amino acid residue at position 400 (position 383 in the sequence without signal peptide) is not a leucine residue; the amino acid residue at position 406 (position 389 in the sequence without signal peptide) is not a glycine residue; the amino acid residue at position 410 (position 393 in the sequence without signal peptide) is not a leucine residue; the amino acid residue at position 411 (position 394 in the sequence without signal peptide) is not an alanine residue; the amino acid residue at position 414 (position 397 in the sequence without signal peptide) is not a methionine residue; the amino acid residue at position 417 (position 400 in the sequence without signal peptide) is not a serine residue; the amino acid residue at position 420 (position 403 in the sequence without signal peptide) is not a serine residue; the amino acid residue at position 423 (position 406 in the sequence without signal peptide) is not an alanine residue; the amino acid residue at position 424 (position 407 in the sequence without signal peptide) is not a methionine residue; the amino acid residue at position 426 (position 409 in the sequence without signal peptide) is not a cysteine or an aspartic acid residue; amino acid residue at position 428 (position 411 in the sequence without signal peptide) is not a proline residue; amino acid residue at position 429 (position 412 in the sequence without signal peptide) is not a lysine residue; amino acid residue at position 436 (position 419 in the sequence without signal peptide) is not a histidine residue; amino acid residue at position 445 (position 428 in the sequence without signal peptide) is not a proline residue; amino acid residue at position 450 (position 433 in the sequence without signal peptide) is not a histidine or a cysteine residue; amino acid residue at position 452 (position 435 in the sequence without signal peptide) is not a lysine residue; amino acid residue at position 454 (position 437 in the sequence without signal peptide) is not an arginine residue; amino acid residue at position 455 (position 438 in the sequence without signal peptide) is not a serine or an aspartic acid residue; amino acid residue at position 456 (position 439 in the sequence without signal peptide) is not a tryptophan or an arginine residue; amino acid residue at position 459 (position 442 in the sequence without signal peptide) is not a methionine or a leucine residue; amino acid residue at position 466 (position 449 in the sequence without signal peptide) is not a leucine residue; amino acid residue at position 467 (position 450 in the sequence without signal peptide) is not a threonine residue; amino acid residue at position 468 (position 451 in the sequence without signal peptide) is not a threonine residue; amino acid residue at position 473 (position 456 in the sequence without signal peptide) is not a serine residue; amino acid residue at position 476 (position 459 in the sequence without signal peptide) is not a lysine or a glycine residue; amino acid residue at position 478 (position 461 in the sequence without signal peptide) is not a leucine residue; amino acid residue at position 489 (position 472 in the sequence without signal peptide) is not a serine residue; amino acid residue at position 490 (position 473 in the sequence without signal peptide) is not a phenylalanine residue; and amino acid residue at position 491 (position 474 in the sequence without signal peptide) is not an arginine residue. In other specific embodiments, one or more Xs are defined as being any of the amino acid residues found at that position in the sequences of the alignment or a residue that constitutes a conserved or semi-conserved substitution of any of these amino acid residues. In other specific embodiments, X's are defined as being any of the amino acid residues found at that position in the sequences of the alignment. For instance, the amino acid residue at position 51 (position 34 in the sequence without signal peptide) is an alanine or a valine residue; the amino acid residue at position 177 (position 160 in the sequence without signal peptide) is an alanine or a serine residue; the amino acid residue at position 212 (position 195 in the sequence without signal peptide) is an isoleucine or a valine residue; the amino acid residue at position 291 (position 274 in the sequence without signal peptide) is a glutamic acid or an aspartic acid residue; and the amino acid residue at position 374 (position 357 in the sequence without signal peptide) is a valine or an isoleucine residue.

An sALP may optionally be glycosylated at any appropriate one or more amino acid residues.

In addition, an sALP may have at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to any of the sALPs described herein.

An sALP may have 1, 2, 3, 4, 5, 6, 7, 8, 9, 10, or more additions, deletions, or substitutions relative to any of the sALPs described herein.

NPs

Any natriuretic peptide or variant thereof that is an agonist of natriuretic peptide receptor B ("NPR-B"), e.g., human NPR-B, may be used in any of the methods and compositions described herein.

Natriuretic peptides as described herein are peptides that are capable of agonizing NPR-B. Natriuretic peptides include atrial natriuretic peptide (ANP), brain natriuretic peptide (BNP), and C-type natriuretic peptide (CNP). These peptides bind to three types of receptors that signal intracellularly to modulate physiological functions. ANP and BNP bind preferentially to natriuretic peptide receptor A (NPR-A) (also known as guanylyl cyclase A (GC-A)), and CNP binds preferentially to natriuretic peptide receptor B (NPR-B) (also known as guanylyl cyclase B (GC-B)). All three peptides have similar affinity for natriuretic peptide receptor C(NPR-C), which has both signaling and peptide clearance functions. Clearance of natriuretic peptides also occurs through the action of membrane-bound neutral endopeptidase (NEP). Peptide binding to NPR-A or NPR-B activates the intracellular guanylyl cyclase domain of these receptors, which produces the second messenger cGMP. cGMP activates or inhibits multiple signaling pathways inside the cell.

Natriuretic peptides, including CNP, which primarily agonizes NPR-B, and ANP and BNP, which primarily agonize NPR-A, have important roles in multiple biological processes. Multiple sequence alignments of various NP family members and consensus sequences are shown in FIGS. 12-14 and 15A-15G.

A key downstream effect of CNP22 and CNP53, and variants thereof as described herein, in agonizing NPR-B is endochondral ossification. Thus, the NPs described herein are useful, e.g., for treating a wide array of disorders associated with overactivation of FGFR3 and vascular smooth muscle disorders.

Figure 16:
FIG. 16 is a schematic diagram of the structure of a natriuretic peptide as described herein, which includes an optional N-terminal extension, an optional short segment, a required ring domain, and an optional C-terminal extension.

NPs include the schematic structure shown in FIG. 16, wherein the ring domain is required and each of the N-terminal extension, short segment, and C-terminal extension is optional. The ring domain is 17 amino acid residues long, with cysteine residues at each terminus of the ring domain (positions 1 and 17) that form a disulfide bond. In some embodiments, the ring domain has an amino acid sequence that falls within one of the consensus sequences shown in FIG. 12, 14, or 15A-15G (SEQ ID NO: 6, amino acid residues 11-27 of SEQ ID NO: 30, or SEQ ID NO: 95, respectively). Any of the ring domains shown in FIGS. 12-14 and 15A-15G may be used in an NP as described herein.

The short segment is a segment immediately N-terminal to the ring domain that is between 0 and 10 amino acid residues (e.g., 0, 1, 2, 3, 4, 5, 6, 7, 8, 9, or 10 amino acid residues) in length. Exemplary short segments are shown immediately N-terminal to the boxed region in FIG. 12 or FIG. 14, e.g., residues 1-5 of SEQ ID NO: 4, or the 1, 2, 3, 4, 5, 6, 7, 8, 9, or 10 amino acid residues immediately N-terminal to the conserved ring domain in any of the species shown in FIGS. 14 and 15A-15G. In some embodiments, the short segment consists of the 5-amino acid portion immediately N-terminal to the conserved ring domain in any of the species shown in FIG. 12, 14, or 15A-15G. In some embodiments, the short segment confers increased selectivity for NPR-B relative to NPR-A.

The N-terminal extension is a region immediately N-terminal to the short segment (if the short segment is present) or the ring domain (if the short segment is not present) and may be of any length, e.g., 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 125, 150, 175, 200, 250, 300, 350, 400, 450, 500, or even more amino acid residues. This region is absent in CNP22 but is present in CNP53 (residues 1-31 of SEQ ID NO: 11). Exemplary N-terminal extensions are the 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 225, 250, or more residues immediately N-terminal to the short segment, e.g., of 5 amino acid residues (if short segment is present), or immediately N-terminal to the ring domain (if short segment is not present), of any of the species shown in FIGS. 15A-15G. In some embodiments, the N-terminal extension provides increased selectivity for NPR-B relative to NPR-A.

The C-terminal extension is a region immediately C-terminal to the ring domain and may be of any length, e.g., 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 125, 150, 175, 200, 250, 300, 350, 400, 450, 500, or even more amino acid residues. This region is absent in CNP22 and CNP53 but is present in the hybrid peptide CDNP (SEQ ID NO: 100, FIG. 24). Additional variants of CDNP include those that have one or more mutations that provide reduced NEP degradation, such as those provided in FIG. 24: CDNP-N1 (SEQ ID NO: 101), CDNP-G1 (SEQ ID NO: 102), CDNP-H1 (SEQ ID NO: 103), and CDNP-K1 (SEQ ID NO: 104).

Exemplary C-terminal extensions are shown immediately C-terminal to the boxed region in FIG. 12, e.g., amino acid residues 24-28 of SEQ ID NO: 1, amino acid residues 28-32 of SEQ ID NO: 2, amino acid residues 27-32 of SEQ ID NO: 3, or amino acid residues 24-38 of SEQ ID NO: 5. In some embodiments, the C-terminal tail includes, or consists of, the DNP C-terminal tail (SEQ ID NO: 117), or a variant thereof having one or more addition, deletion, or substitution mutations (e.g., SEQ ID NO: 118). For example, a C-terminal tail of an NP may include any of the DNP C-terminal tail mutations shown in FIG. 24. In particular, residues 1, 3, 4, 5, 6, and/or 7 of the DNP C-terminal tail (SEQ ID NO: 117) may be mutated, e.g., as in any of the mutations shown in FIG. 24. In some embodiments, the C-terminal extension confers increased selectivity for NPR-B relative to NPR-A.

An NP may optionally be glycosylated at any appropriate one or more amino acid residues.

In addition, an NP may have at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to any of the NPs described herein, or to one or more of the ring domain, the short segment, the C-terminal extension, or the N-terminal extension.

An NP may have 1, 2, 3, 4, 5, 6, 7, 8, 9, 10, or more additions, deletions, or substitutions relative to any of the NPs described herein, or to one or more of the ring domain, the short segment, the C-terminal extension, or the N-terminal extension.

In one example, the NP can have one or more mutations that are less sensitive to oxidation without substantially reducing potency or efficacy. For example, residue 17 of CNP22 is one of the less well-conserved positions in CNP22, with naturally-occurring homologs having (without limitation) Phe, Leu, Ile, Thr, Val, or Ser at this position (see, e.g., FIG. 14). Exemplary CNP22 variants include CNP-F17 (SEQ ID NO: 119); CNP-L17 (SEQ ID NO: 120); CNP-I17 (SEQ ID NO: 121); CNP-T17 (SEQ ID NO: 122); CNP-V17 (SEQ ID NO: 123); CNP-A17 (SEQ ID NO: 124); CNP-S17 (SEQ ID NO: 125); CNP-E17 (SEQ ID NO: 156); CNP-R17 (SEQ ID NO: 157); and CNP-Y17 (SEQ ID NO: 158), where the consensus sequence is shown in SEQ ID NO: 126 (where X can be any amino acid, including, without limitation, Phe, Leu, Ile, Thr, Glu, Arg, Tyr, Cys, Pro, Asp, Val, Ala, or Ser) (FIG. 26). Additional exemplary CNP22 variants include those having a point mutation at position 17, as shown in FIG. 30 (SEQ ID NOs: 126, 119-122, and 156-172), where X in SEQ ID NOs: 126 or 162 can be any amino acid, e.g., F, L, I, T, E, R, Y, C, P, or D.

In another example, the NP can have one or more mutations that provide increased resistance to one or more enzymes that cleave CNP in vivo (e.g., neutral endopeptidase (NEP) and/or insulin degrading enzyme (IDE)). Exemplary molecules are shown in FIG. 27 (SEQ ID NOs: 127-150), FIGS. 28A-28E (SEQ ID NOs: 1001-1155), and FIG. 29 (SEQ ID NOs: 4, 115, 119, 120, 122, 128-139, 147, 148, and 150-155).

An NP as described herein may include any other sequence or moiety, attached covalently or non-covalently, provided that the NP has the ability to agonize NPR-B.

In some embodiments, an NP as described herein may be no more than 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 70, 80, 90, 100, 110, or 120 amino acid residues in length. Furthermore, in some embodiments, an NP as described herein may be no more than 1.8, 2.0, 2.2, 2.4, 2.6, 2.8, 3.0, 3.2, 3.4, 3.6, 3.8, 4.0, 4.2, 4.4, 4.6, 4.8, 5.0, 5.2, 5.4, 5.6, 5.8, 6.0, 6.2, 6.4, 6.6, 6.8, 7.0, 7.2, 7.4, 7.6, 7.8, 8.0, 8.2, 8.4, 8.6, 8.8, 9.0, 9.2, 9.4, 9.6, 9.8, or 10.0 kilodaltons (kDa) in molecular weight.

NPs that are suitable for use in the compositions and methods described herein include those described, e.g., in U.S. Pat. Nos. 5,352,770; 5,434,133; 6,020,168; 6,034,231; 6,407,211; 6,743,425; 6,818,619; 7,276,481; 7,384,917; and 7,754,852; U.S. Application Pub. Nos. 2007-0197434; 2008-0181903; 2008-0312142; 2009-0170756; 2010-0055150; and 2010-0297021; International Application Pub. Nos. WO 94/20534; WO 02/047871; WO 2004/047871; WO 2005/098490; WO 2008/154226; and WO 2009/067639; European Application Pub. Nos. EP 0497368 and EP 0466174; Furuya et al., Biochem. Biophys. Res. Comm. 183: 964-969 (1992); Takano et al., Zool. Sci., 11: 451-454 (1994); Plater et al., Toxicon., 36(6): 847-857 (1998); and Inoue et al., Proc. Nat. Acad. Sci., 100(17): 10079-10084 (2003), each of which is hereby incorporated by reference in its entirety, including all formulas, structures, and sequences for natriuretic peptides and variants thereof. In alternative embodiments, the NPs referenced in the present paragraph are excluded from the compositions and methods described herein.

In some embodiments, any of the NPs described or incorporated by reference herein may be used in the compositions and methods described herein without fusion to an Fc domain or to a linker, or alternatively may be fused to any of the linkers described herein but not to an Fc domain. Such NPs may be used to treat a neurocutaneous syndrome, a disorder associated with overactivation of FGFR3, e.g., achondroplasia, a bone or cartilage disorder, a vascular smooth muscle disorder, or a condition for elongation of bone, as described herein.

In other embodiments, any of the NPs described or incorporated by reference herein may include a point mutation at position 17 relative to CNP22. Wild-type CNP22 has a methionine at position 17 relative to CNP22, which can be oxidized in vivo and/or which can provide a peptide that is degradable by a protease. As described herein, point mutations at position 17 relative to CNP22 could provide polypeptides having decreased degradation, while maintaining potency. Exemplary amino acid residues at position 17 relative to CNP22 are Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu. For example, the amino acid at position 17 relative to CNP22 could be Phe, Leu, Ile, Thr, Glu, Arg, Tyr, Cys, Pro, and Asp, e.g., Phe or Leu, e.g., Phe, e.g., Leu. In another example, the amino acid at position 17 relative to CNP22 could be Phe, Leu, Ile, Thr, Val, Ala, or Ser. Alternatively, exemplary amino acid residues at position 17 relative to CNP22 are Gly, Ala, Ser, Val, Trp, Asn, Gln, His, or Lys.

Furthermore, included in the compositions and methods described herein are nucleic acid molecules encoding any of the NPs and fusion polypeptides described herein, as well as nucleic acid molecules that hybridize under high stringency conditions to at least a portion, e.g., to 20%, 30%, 40%, 50%, 60%, 70%, 75%, 80%, 85%, 90%, 95%, 96%, 97%, 98%, 99%, or even 100%, of a nucleic acid molecule that encodes any of the NPs or fusion polypeptides described herein.

Fragment Crystallizable Region (Fc) Fragments

The fusion polypeptides of the invention may include an N-terminal or C-terminal domain such as Fc, a fragment crystallizable region of an immunoglobulin. For example, an sALP polypeptide and/or an NP polypeptide of the invention can be a fusion polypeptide including an Fc. An immunoglobulin molecule has a structure that is well known in the art. It includes two light chains (~23 kD each) and two heavy chains (~50-70 kD each) joined by inter-chain disulfide bonds. Immunoglobulins are readily cleaved proteolytically (e.g., by papain cleavage) into Fab (containing the light chain and the VH and CH1 domains of the heavy chain) and Fc (containing the $C_{H2}$ and $C_{H3}$ domains of the heavy chain, along with adjoining sequences). Cleavage typically occurs in a flexible hinge region joining the Fab and Fc regions. For example, papain cleaves the hinge region immediately before the disulfide bonds joining the two heavy chains.

Useful Fc fragments as described herein include the Fc fragment of any immunoglobulin molecule, including IgG, IgM, IgA, IgD, or IgE, and their various subclasses (e.g., IgG-1, IgG-2, IgG-3, IgG-4, IgA-1, IgA-2), taken from any mammal (e.g., human). The Fc fragments of the invention may include, for example, the $C_{H2}$ and $C_{H3}$ domains of the heavy chain, as well as any portion of the hinge region. Furthermore, the Fc region may optionally be glycosylated at any appropriate one or more amino acid residues, e.g., various amino acid residues known to those skilled in the art. In some embodiments, the Fc fragment is of human IgG-1. In particular embodiments, the Fc fragment of the fusion polypeptide has the amino acid sequence of SEQ ID NO: 401, or has at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to SEQ ID NO: 401 (FIG. 7).

In some embodiments, engineered, e.g., non-naturally occurring, Fc regions may be utilized in the compositions and methods of the invention, e.g., as described in International Application Pub. No. WO2005/007809, which is hereby incorporated by reference.

An Fc fragment as described herein may have 1, 2, 3, 4, 5, 6, 7, 8, 9, 10, 11, 12, 13, 14, 15, 16, 17, 18, 19, 20, 25, 30, 35, 40, 50, or more additions, deletions, or substitutions relative to any of the Fc fragments described herein.

Linkers

The fusion proteins described herein may include a peptide linker region between the Fc fragment and the sALP or between the Fc fragment and the NP. In addition, a peptide linker region may be included between the Fc fragment and the optional bone-targeting moiety. The linker region may be of any sequence and length that allows the sALP or the NP to remain biologically active, e.g., not sterically hindered. Exemplary linker lengths are between 1 and 200 amino acid residues, e.g., 1-5, 6-10, 11-15, 16-20, 21-25, 26-30, 31-35, 36-40, 41-45, 46-50, 51-55, 56-60, 61-65, 66-70, 71-75, 76-80, 81-85, 86-90, 91-95, 96-100, 101-110, 111-120, 121-130, 131-140, 141-150, 151-160, 161-170, 171-180, 181-190, or 191-200 amino acid residues. Additional exemplary linker lengths are 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, or 200 amino acid residues. Additional exemplary linker lengths are 14-18, 20-24, 26-30, 32-36, 38-42, and 44-48 amino acid residues.

In some embodiments, linkers include or consist of flexible portions, e.g., regions without significant fixed secondary or tertiary structure. Exemplary flexible linkers are glycine-rich linkers, e.g., containing at least 50%, 60%, 65%, 70%, 75%, 80%, 85%, 90%, 95%, or even 100% glycine residues. Linkers may also contain, e.g., serine residues. In some cases, the amino acid sequence of linkers consists only of glycine and serine residues.

In some cases, the amino acid sequence of the linker sequence includes or consists of a sequence according to the formula $[(Gly)_m(Ser)]_n(Gly)_p$, where each of m, n, and p is, independently, 0, 1, 2, 3, 4, 5, 6, 7, 8, 9, 10, 11, 12, 13, 14, 15, 16, 17, 18, 19, or 20. In some embodiments, m=1, 2, 3, 4, 5, or 6; n=1, 2, 3, 4, 5, 6, 7, 8, 9, or 10; and p=0, 1, 2, 3, or 4. Alternatively, the linker sequence includes or consists of a sequence according to the formula $(Gly)_p[(Ser)(Gly)_m]_n$, where each of m, n, and p is, independently, 0, 1, 2, 3, 4, 5, 6, 7, 8, 9, 10, 11, 12, 13, 14, 15, 16, 17, 18, 19, or 20. In some embodiments, m=1, 2, 3, 4, 5, or 6; n=1, 2, 3, 4, 5, 6, 7, 8, 9, or 10; and p=0, 1, 2, 3, or 4.

Exemplary combinations of m, n, and p values for either of the preceding two formulae are listed in Table 2.

TABLE 2

| m | n | p |
|---|---|---|
| N/A | 0 | 1 |
| N/A | 0 | 2 |
| N/A | 0 | 3 |
| N/A | 0 | 4 |
| N/A | 0 | 5 |
| N/A | 0 | 6 |
| N/A | 0 | 7 |
| N/A | 0 | 8 |
| N/A | 0 | 9 |
| N/A | 0 | 10 |
| 1 | 1 | 0 |
| 1 | 2 | 0 |
| 1 | 3 | 0 |
| 1 | 4 | 0 |
| 1 | 5 | 0 |
| 1 | 6 | 0 |
| 1 | 7 | 0 |
| 1 | 8 | 0 |
| 1 | 9 | 0 |
| 1 | 10 | 0 |
| 2 | 1 | 0 |
| 2 | 2 | 0 |
| 2 | 3 | 0 |
| 2 | 4 | 0 |
| 2 | 5 | 0 |
| 2 | 6 | 0 |
| 2 | 7 | 0 |
| 2 | 8 | 0 |
| 2 | 9 | 0 |
| 2 | 10 | 0 |
| 3 | 1 | 0 |
| 3 | 2 | 0 |
| 3 | 3 | 0 |
| 3 | 4 | 0 |
| 3 | 5 | 0 |
| 3 | 6 | 0 |
| 3 | 7 | 0 |
| 3 | 8 | 0 |
| 3 | 9 | 0 |
| 3 | 10 | 0 |
| 4 | 1 | 0 |
| 4 | 2 | 0 |
| 4 | 3 | 0 |
| 4 | 4 | 0 |
| 4 | 5 | 0 |
| 4 | 6 | 0 |
| 4 | 7 | 0 |
| 4 | 8 | 0 |
| 4 | 9 | 0 |
| 4 | 10 | 0 |
| 5 | 1 | 0 |
| 5 | 2 | 0 |
| 5 | 3 | 0 |
| 5 | 4 | 0 |
| 5 | 5 | 0 |
| 5 | 6 | 0 |
| 5 | 7 | 0 |
| 5 | 8 | 0 |
| 5 | 9 | 0 |
| 5 | 10 | 0 |
| 6 | 1 | 0 |
| 6 | 2 | 0 |
| 6 | 3 | 0 |
| 6 | 4 | 0 |
| 6 | 5 | 0 |
| 6 | 6 | 0 |
| 6 | 7 | 0 |
| 6 | 8 | 0 |
| 6 | 9 | 0 |
| 6 | 10 | 0 |
| 1 | 1 | 1 |
| 1 | 2 | 1 |
| 1 | 3 | 1 |
| 1 | 4 | 1 |
| 1 | 5 | 1 |
| 1 | 6 | 1 |
| 1 | 7 | 1 |
| 1 | 8 | 1 |
| 1 | 9 | 1 |
| 1 | 10 | 1 |
| 2 | 1 | 1 |
| 2 | 2 | 1 |
| 2 | 3 | 1 |
| 2 | 4 | 1 |
| 2 | 5 | 1 |
| 2 | 6 | 1 |
| 2 | 7 | 1 |
| 2 | 8 | 1 |
| 2 | 9 | 1 |
| 2 | 10 | 1 |
| 3 | 1 | 1 |
| 3 | 2 | 1 |
| 3 | 3 | 1 |
| 3 | 4 | 1 |
| 3 | 5 | 1 |
| 3 | 6 | 1 |
| 3 | 7 | 1 |
| 3 | 8 | 1 |
| 3 | 9 | 1 |
| 3 | 10 | 1 |
| 4 | 1 | 1 |
| 4 | 2 | 1 |
| 4 | 3 | 1 |
| 4 | 4 | 1 |
| 4 | 5 | 1 |
| 4 | 6 | 1 |
| 4 | 7 | 1 |
| 4 | 8 | 1 |
| 4 | 9 | 1 |
| 4 | 10 | 1 |
| 5 | 1 | 1 |
| 5 | 2 | 1 |
| 5 | 3 | 1 |
| 5 | 4 | 1 |
| 5 | 5 | 1 |
| 5 | 6 | 1 |
| 5 | 7 | 1 |
| 5 | 8 | 1 |
| 5 | 9 | 1 |
| 5 | 10 | 1 |

TABLE 2-continued

| m | n | p |
|---|---|---|
| 6 | 1 | 1 |
| 6 | 2 | 1 |
| 6 | 3 | 1 |
| 6 | 4 | 1 |
| 6 | 5 | 1 |
| 6 | 6 | 1 |
| 6 | 7 | 1 |
| 6 | 8 | 1 |
| 6 | 9 | 1 |
| 6 | 10 | 1 |
| 1 | 1 | 2 |
| 1 | 2 | 2 |
| 1 | 3 | 2 |
| 1 | 4 | 2 |
| 1 | 5 | 2 |
| 1 | 6 | 2 |
| 1 | 7 | 2 |
| 1 | 8 | 2 |
| 1 | 9 | 2 |
| 1 | 10 | 2 |
| 2 | 1 | 2 |
| 2 | 2 | 2 |
| 2 | 3 | 2 |
| 2 | 4 | 2 |
| 2 | 5 | 2 |
| 2 | 6 | 2 |
| 2 | 7 | 2 |
| 2 | 8 | 2 |
| 2 | 9 | 2 |
| 2 | 10 | 2 |
| 3 | 1 | 2 |
| 3 | 2 | 2 |
| 3 | 3 | 2 |
| 3 | 4 | 2 |
| 3 | 5 | 2 |
| 3 | 6 | 2 |
| 3 | 7 | 2 |
| 3 | 8 | 2 |
| 3 | 9 | 2 |
| 3 | 10 | 2 |
| 4 | 1 | 2 |
| 4 | 2 | 2 |
| 4 | 3 | 2 |
| 4 | 4 | 2 |
| 4 | 5 | 2 |
| 4 | 6 | 2 |
| 4 | 7 | 2 |
| 4 | 8 | 2 |
| 4 | 9 | 2 |
| 4 | 10 | 2 |
| 5 | 1 | 2 |
| 5 | 2 | 2 |
| 5 | 3 | 2 |
| 5 | 4 | 2 |
| 5 | 5 | 2 |
| 5 | 6 | 2 |
| 5 | 7 | 2 |
| 5 | 8 | 2 |
| 5 | 9 | 2 |
| 5 | 10 | 2 |
| 6 | 1 | 2 |
| 6 | 2 | 2 |
| 6 | 3 | 2 |
| 6 | 4 | 2 |
| 6 | 5 | 2 |
| 6 | 6 | 2 |
| 6 | 7 | 2 |
| 6 | 8 | 2 |
| 6 | 9 | 2 |
| 6 | 10 | 2 |
| 1 | 1 | 3 |
| 1 | 2 | 3 |
| 1 | 3 | 3 |
| 1 | 4 | 3 |
| 1 | 5 | 3 |
| 1 | 6 | 3 |
| 1 | 7 | 3 |
| 1 | 8 | 3 |
| 1 | 9 | 3 |
| 1 | 10 | 3 |
| 2 | 1 | 3 |
| 2 | 2 | 3 |
| 2 | 3 | 3 |
| 2 | 4 | 3 |
| 2 | 5 | 3 |
| 2 | 6 | 3 |
| 2 | 7 | 3 |
| 2 | 8 | 3 |
| 2 | 9 | 3 |
| 2 | 10 | 3 |
| 3 | 1 | 3 |
| 3 | 2 | 3 |
| 3 | 3 | 3 |
| 3 | 4 | 3 |
| 3 | 5 | 3 |
| 3 | 6 | 3 |
| 3 | 7 | 3 |
| 3 | 8 | 3 |
| 3 | 9 | 3 |
| 3 | 10 | 3 |
| 4 | 1 | 3 |
| 4 | 2 | 3 |
| 4 | 3 | 3 |
| 4 | 4 | 3 |
| 4 | 5 | 3 |
| 4 | 6 | 3 |
| 4 | 7 | 3 |
| 4 | 8 | 3 |
| 4 | 9 | 3 |
| 4 | 10 | 3 |
| 5 | 1 | 3 |
| 5 | 2 | 3 |
| 5 | 3 | 3 |
| 5 | 4 | 3 |
| 5 | 5 | 3 |
| 5 | 6 | 3 |
| 5 | 7 | 3 |
| 5 | 8 | 3 |
| 5 | 9 | 3 |
| 5 | 10 | 3 |
| 6 | 1 | 3 |
| 6 | 2 | 3 |
| 6 | 3 | 3 |
| 6 | 4 | 3 |
| 6 | 5 | 3 |
| 6 | 6 | 3 |
| 6 | 7 | 3 |
| 6 | 8 | 3 |
| 6 | 9 | 3 |
| 6 | 10 | 3 |
| 1 | 1 | 4 |
| 1 | 2 | 4 |
| 1 | 3 | 4 |
| 1 | 4 | 4 |
| 1 | 5 | 4 |
| 1 | 6 | 4 |
| 1 | 7 | 4 |
| 1 | 8 | 4 |
| 1 | 9 | 4 |
| 1 | 10 | 4 |
| 2 | 1 | 4 |
| 2 | 2 | 4 |
| 2 | 3 | 4 |
| 2 | 4 | 4 |
| 2 | 5 | 4 |
| 2 | 6 | 4 |
| 2 | 7 | 4 |
| 2 | 8 | 4 |
| 2 | 9 | 4 |
| 2 | 10 | 4 |
| 3 | 1 | 4 |
| 3 | 2 | 4 |
| 3 | 3 | 4 |
| 3 | 4 | 4 |
| 3 | 5 | 4 |
| 3 | 6 | 4 |

TABLE 2-continued

| m | n | p |
|---|---|---|
| 3 | 7 | 4 |
| 3 | 8 | 4 |
| 3 | 9 | 4 |
| 3 | 10 | 4 |
| 4 | 1 | 4 |
| 4 | 2 | 4 |
| 4 | 3 | 4 |
| 4 | 4 | 4 |
| 4 | 5 | 4 |
| 4 | 6 | 4 |
| 4 | 7 | 4 |
| 4 | 8 | 4 |
| 4 | 9 | 4 |
| 4 | 10 | 4 |
| 5 | 1 | 4 |
| 5 | 2 | 4 |
| 5 | 3 | 4 |
| 5 | 4 | 4 |
| 5 | 5 | 4 |
| 5 | 6 | 4 |
| 5 | 7 | 4 |
| 5 | 8 | 4 |
| 5 | 9 | 4 |
| 5 | 10 | 4 |
| 6 | 1 | 4 |
| 6 | 2 | 4 |
| 6 | 3 | 4 |
| 6 | 4 | 4 |
| 6 | 5 | 4 |
| 6 | 6 | 4 |
| 6 | 7 | 4 |
| 6 | 8 | 4 |
| 6 | 9 | 4 |
| 6 | 10 | 4 |

In some embodiments, the amino acid sequence of the linker (e.g., between the Fc and the sALP, or between the Fc and the NP, or between the Fc and the optional bone-targeting moiety) includes or consists of a sequence in Table 3.

TABLE 3

| Linker sequence | SEQ ID NO. |
|---|---|
| G | 301 |
| GG | 302 |
| GGG | 303 |
| GGGG | 304 |
| GGGGS | 305 |
| GGGGSG | 306 |
| GGGGSGGGGSGGGG | 307 |
| GGGGSGGGGSGGGGSG | 308 |
| GGGGSGGGGSGGGGSGGGGSGG | 309 |
| GGGGSGGGGSGGGGSGGGGSGGGGSGGG | 310 |
| GGGGSGGGGSGGGGSGGGGSGGGGSGGGGSGGGG | 311 |
| GGGGSGGGGSGGGGSGGGGSGGGGSGGGGSGGGGS | 312 |
| GGGGSGGGGSGGGGSGGGGSGGGGSGGGGSGGGGSGGGGSG | 313 |
| KGANKK | 314 |
| KGANQK | 315 |
| KGANKQ | 316 |
| KGANQQ | 317 |
| QGANKK | 318 |
| QGANQK | 319 |
| QGANKQ | 320 |
| QGANQQ | 321 |
| GGGGSGGGGSKGANKK | 322 |
| GGGGSGGGGSKGANQK | 323 |
| GGGGSGGGGSKGANKQ | 324 |
| GGGGSGGGGSKGANQQ | 325 |
| GGGGSGGGGSQGANKK | 326 |
| GGGGSGGGGSQGANQK | 327 |
| GGGGSGGGGSQGANKQ | 328 |
| GGGGSGGGGSQGANQQ | 329 |
| GGGDLQVDTQSQAAWAQLLQEHPNAQQYKGANKK | 330 |
| GGGGSGGGGSGGGGSGGGGSGGGGSGGGKGANKK | 331 |
| GGGGSGGGGSGGGGSGGGGSGGGGSGGGKGANQK | 332 |
| GGGGSGGGGSGGGGSGGGGSGGGGSGGGQGANQQ | 333 |
| QEHPNARKYKGANKK | 334 |
| GQEHPNARKYKGANKK | 335 |
| PGQEHPNARKYKGANKK | 336 |
| SGGGGSGGGGSGGGG | 337 |
| ASTSPANPQPAASSP | 338 |
| PSSAAPQPNAPSTSA | 339 |
| SGGGGSGGGKGANKK | 340 |
| SGGGGSGGGQGANQQ | 341 |
| SGGGGSGGGKGANKQ | 342 |
| SGGGGSGGGKGANQK | 343 |
| SGGGGSGGGQGANKK | 344 |
| SGGGGSGGGKGANQQ | 345 |
| SGGGGSGGGQGANQK | 346 |
| SGGGGSGGGQGANKQ | 347 |
| ASTSPANPQPAASSG | 348 |
| GSSAAPQPNAPSTSA | 349 |
| GSSAAPRPNAPSTSAGLSKG | 350 |
| ASTSPANPRPAASSG | 351 |
| HGPQGQEHPNARKYKGANKK | 352 |

TABLE 3-continued

| Linker sequence | SEQ ID NO. |
|---|---|
| HKLRGQEHPNARKYKGANKK | 353 |
| GHGPQGQEHPNARKYKGANKK | 354 |
| GHKLRGQEHPNARKYKGANKK | 355 |
| GGHGPQGQEHPNARKYKGANKK | 356 |
| GGHKLRGQEHPNARKYKGANKK | 357 |
| GGGHGPQGQEHPNARKYKGANKK | 358 |
| GGGHKLRGQEHPNARKYKGANKK | 359 |
| GGGGHGPQGQEHPNARKYKGANKK | 360 |
| GGGGHKLRGQEHPNARKYKGANKK | 361 |
| GGGGGHGPQGQEHPNARKYKGANKK | 362 |
| GGGGGHKLRGQEHPNARKYKGANKK | 363 |
| HGPQGSGGGGSGGGKGANKK | 364 |
| HKLRGSGGGGSGGGKGANKK | 365 |
| GGGHGPQGSGGGGSGGGKGANKK | 366 |
| GGGHKLRGSGGGGSGGGKGANKK | 367 |
| SGGGGQEHPNARKYKGANKK | 368 |
| GGGSGGGGQEHPNARKYKGANKK | 369 |
| SGGGGSGGGGSGGGKGANKK | 370 |
| SGGGGSGGGGSGGGGSGGGKGANKK | 371 |
| GGGSGGGGSGGGGSGGGKGANKK | 372 |
| GGGSGGGGSGGGGSGGGGSGGGKGANKK | 373 |
| HGPQG | 374 |
| HKLRG | 375 |
| GHGPQG | 376 |
| GGHGPQG | 377 |
| GGGHGPQG | 378 |
| GGGGHGPQG | 379 |
| GGGGGHGPQG | 380 |
| GHKLRG | 381 |
| GGHKLRG | 382 |
| GGGHKLRG | 383 |
| GGGGHKLRG | 384 |
| GGGGGHKLRG | 385 |
| GGQEHPNARKYKGANKK | 386 |
| GGGQEHPNARKYKGANKK | 387 |
| GGGGQEHPNARKYKGANKK | 388 |
| GGGGGQEHPNARKYKGANKK | 389 |
| LK | 390 |
| DI | 391 |

In some embodiments, the linker may include or consist of a [(Gly)$_m$(Ser)]$_n$(Gly)$_p$ or (Gly)$_p$[(Ser)(Gly)$_m$]$_n$ linker as described above, followed by one of SEQ ID NOs: 314-321, e.g., one of SEQ ID NOs: 314, 315, or 321.

In other embodiments of polypeptides including an sALP, the linker may include or consist of all or a fragment of an sALP. For example, the 17-amino acid portion of human TNALP that is an N-terminal signal sequence, or homologs or variants or fragments thereof (e.g., residues 1-17 of SEQ ID NOs: 1202 or 1208), may be used as a linker. Homologs of this 17-amino acid region may be identified, e.g., by consulting a sequence alignment such as FIG. 8 (residues 1-17 of SEQ ID NO: 1216, where X can be any amino acid) or in FIG. 11 (residues 1-17 of SEQ ID NO: 1219, where X can be any amino acid but not a pathogenic mutation provided in Table 1). In another example, the C-terminal GPI anchor portion of human TNALP, or homologs or variants or fragments thereof (e.g., residues 503-524 of SEQ ID NO: 1208) may be used as a linker. Homologs of this C-terminal region may be identified, e.g., by consulting a sequence alignment such as FIG. 8 (residues 503-524 of SEQ ID NO: 1216, where X can be any amino acid) or in FIG. 11 (residues 503-524 of SEQ ID NO: 1219, where X can be any amino acid but not a pathogenic mutation provided in Table 1).

In other embodiments of polypeptides including an NP, the linker may include or consist of all or a fragment of an NP. For example, the 31-amino acid portion of human CNP53 that is N-terminal to CNP22, or homologs or variants thereof (e.g., residues 4-34 of SEQ ID NO: 320), may be used as a linker. Homologs of this 31-amino acid region may be identified, e.g., by consulting a sequence alignment such as FIGS. 15A-15G and identifying the regions corresponding to the N-terminal 31 amino acid residues of human CNP53. Other suitable linkers may also be identified, e.g., by choosing any portion of an NP, optionally excluding a ring domain, as shown in FIGS. 15A-15G, or in any other NP or region of an NP not shown in FIGS. 15A-15G. For example, the C-terminal extension of DNP (SEQ ID NO: 117), or fragments or variants thereof, may be used as a linker.

A linker may optionally be glycosylated at any appropriate one or more amino acid residues.

In addition, a linker may have at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to any of the linkers described herein. In addition, a linker may have 1, 2, 3, 4, 5, 6, 7, 8, 9, 10, or more additions, deletions, or substitutions relative to any of the linkers described herein.

A linker as described herein may include any other sequence or moiety, attached covalently or non-covalently. In some embodiments, the linker is absent, meaning that the Fc fragment and the sALP are fused together directly or that the Fc fragment and the NP are fused together directly, with no intervening residues.

It should be noted that certain Fc-sALP or sALP-Fc fusion proteins may be viewed, according to the present disclosure, either as 1) having no linker, or as 2) having a linker which corresponds to a portion of the sALP. For example, Fc fused directly to hsTNALP (1-502) may be viewed, e.g., either as having no linker, wherein the NP is hsTNALP (1-502), or as having a 17-amino acid linker, wherein the NP is hsTNALP (18-502).

Further, it should be noted that certain Fc-NP or NP-Fc fusion proteins may be viewed, according to the present disclosure, either as 1) having no linker, or as 2) having a linker which corresponds to a portion of the NP. For example, Fc fused directly to CNP53 may be viewed, e.g., either as having no linker, wherein the NP is CNP53, or as having a 31-amino acid linker, wherein the NP is CNP22.

sALP Polypeptides

Any of the sALPs and linkers described herein may be combined in an sALP polypeptide, e.g., an sALP polypeptide of A-sALP-B, wherein each of A and B is absent or is an amino acid sequence of at least one amino acid. When present, A and/or B can be any linker described herein (e.g., the amino acid sequence of any one of SEQ ID NOs: 301-391). In some embodiments, A is absent, B is absent, or A and B are both absent.

The sALP polypeptides of the invention can optionally include an Fc region to provide an sALP fusion polypeptide, as described herein.

The sALP polypeptide can optionally include a bone-targeting moiety (e.g., any described herein). In some embodiments, a linker, e.g., a flexible linker, may be included between the bone-targeting moiety and the sALP. For example, FIG. 5B provide polypeptides having both a bone-targeting moiety and a linker (shown in bold) between the Fc region and the bone-targeting moiety. In some embodiments, the linker is a dipeptide sequence (e.g., leucine-lysine or aspartic acid-isoleucine) or the amino acid sequence of any one of SEQ ID NOs: 301-391.

The sALP polypeptide can include any ALPs, mutations, N-terminal signal sequence, C-terminal GPI sequence, and/or linkers, or fragments thereof, described herein. For example, the italicized regions in FIGS. 5B-5C and sequences provided in FIG. 6 or 8-11 may be used as for any of the sALPs disclosed herein (e.g., SEQ ID NOs: 1201, 1202, 1204-1216, 1218, and 1219).

sALP Fusion Polypeptides

Any of the sALPs, linkers, and Fc regions described herein may be combined in a fusion polypeptide, e.g., a recombinant fusion polypeptide, that includes the structure C-sALP-D-Fc-E, C-Fc-D-sALP-E, C-sALP-D-Fc-G-$I_n$-H, or C-Fc-D-sALP-G-$I_n$-H, where each of C, D (the linker region), E, G (linker region), and H is absent or is an amino acid sequence of at least one amino acid; I represents an aspartic acid or a glutamic acid; and n=10 to 16. D and G can be absent or can optionally include any linker described herein (e.g., the amino acid sequence of any one of SEQ ID NOs: 301-391).

The polypeptides of the invention optionally include one or more additional amino acid residues 1) at the N-terminus of the polypeptide, 2) between the sALP and Fc regions of the polypeptide, and 3) at the C-terminus of the polypeptide. Thus, the invention includes, for example, polypeptides of the form C-sALP-D-Fc-E or the structure C-Fc-D-sALP-E, where C is one or more (e.g., 2, 3, 4, 5, 6, 7, 8, 9, 10, 11, 12, 13, 14, 15, 17, 20, 25, 30, 35, 40, 45, 50, or more) additional amino acid residues at the N-terminus of the polypeptide, D is one or more (e.g., 2, 3, 4, 5, 6, 7, 8, 9, 10, 11, 12, 13, 14, 15, 17, 20, 25, 30, 35, 40, 45, 50, or more) additional amino acid residues (i.e., a linker) between the sALP and Fc regions of the polypeptide, and E is one or more (e.g., 2, 3, 4, 5, 6, 7, 8, 9, 10, 11, 12, 13, 14, 15, 17, 20, 25, 30, 35, 40, 45, 50, or more) additional amino acid residues at the C-terminus of the polypeptide. In a particular example, D is the dipeptide leucine-lysine. Alternatively, any combination of C, D, and E may be present or absent. For example, in some embodiments, C and E are both absent, and D is absent or is an amino acid sequence of at least one amino acid. For example, the polypeptide may consist of the structure sALP-D-Fc or the structure Fc-D-sALP. In some embodiments of polypeptides consisting of the structure sALP-D-Fc or Fc-D-sALP, D may consist of two amino acid residues, e.g., leucine-lysine. For example, the polypeptide may consist of the structure sALP-D-Fc. Optionally, the amino acid sequence of sALP is the amino acid sequence of SEQ ID NO: 1205, the amino acid sequence of D is leucine-lysine, and/or the amino acid sequence of Fc is the amino acid sequence of SEQ ID NO: 401. In some embodiments, the amino acid sequence of the polypeptide consists of the amino acid sequence of SEQ ID NO: 1204. In some embodiments, polypeptide includes an amino acid sequence of at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to the amino acid sequence of SEQ ID NOs: 1204 or 1221.

In some embodiments, the polypeptide includes a bone-targeting moiety, e.g., having a series of consecutive Asp or Glu residues, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$. The bone-targeting moiety, if present, may be positioned anywhere in the fusion polypeptide, e.g., at or near the N-terminal or C-terminal end, and/or in the linker region. For example, any one of C, D, and/or E may include a bone-targeting moiety. In some embodiments, the bone-targeting moiety is at the C-terminal end. For example, the polypeptide may comprise or consist of the structure C-sALP-D-Fc-G-$I_n$-H or the structure C-Fc-D-sALP-G-$I_n$-H, where each of C, D (the linker region), G (linker region), and H is absent or is an amino acid sequence of at least one amino acid, I represents an aspartic acid or a glutamic acid, and n=10 to 16. In some embodiments, C and H are both absent, and D and G can be absent or can optionally include any linker described herein (e.g., the amino acid sequence of any one of SEQ ID NOs: 301-391). For example, the polypeptide may comprise or consist of the structure sALP-D-Fc-G-$I_n$ or the structure Fc-D-sALP-G-$I_n$.

In some embodiments, polypeptide does not include a bone-targeting moiety.

A fusion polypeptide as described herein may have at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to any of the fusion polypeptides described herein, e.g., SEQ ID NOs: 1201, 1204, 1220, or 1221. In addition, a fusion polypeptide as described herein may have 1, 2, 3, 4, 5, 6, 7, 8, 9, 10, 11, 12, 13, 14, 15, 16, 17, 18, 19, 20, 25, 30, 35, 40, 50, or more additions, deletions, or substitutions relative to any of the fusion polypeptides described herein. Furthermore, in some embodiments, a fusion polypeptide as described herein may be encoded by a nucleic acid molecule that hybridizes under high stringency conditions to at least a portion, e.g., to 20%, 30%, 40%, 50%, 60%, 70%, 75%, 80%, 85%, 90%, 95%, 96%, 97%, 98%, 99%, or even 100%, of a nucleic acid molecule that encodes any of the polypeptides, e.g., fusion polypeptides, described herein.

In some embodiments, additional amino acid residues can be introduced into the polypeptide according to the cloning strategy used to produce the fusion polypeptides. In some embodiments, the additional amino acid residues do not provide an additional GPI anchoring signal so as to maintain the polypeptide in a soluble form. Furthermore, in some embodiments, any such additional amino acid residues, when incorporated into the polypeptide of the invention, do not provide a cleavage site for endoproteases of the host cell. The likelihood that a designed sequence would be cleaved by the endoproteases of the host cell can be predicted as described, e.g., by Ikezawa (*Biol. Pharm. Bull.* 25:409-417, 2002).

In certain embodiments, the polypeptides of the invention are associated into dimers or tetramers. For example, two sALP-Fc monomers can covalently be linked through two disulfide bonds located in the hinge regions of the Fc fragments.

NP Polypeptides

Any of the NPs and linkers described herein may be combined in an NP polypeptide, e.g., an NP polypeptide of V-NP-W, wherein each of V and W is absent or is an amino acid sequence of at least one amino acid.

The NP polypeptides of the invention can optionally include an Fc region to provide an NP fusion polypeptide, as described herein.

The NP polypeptide can optionally include a bone-targeting moiety. In some embodiments, a linker, e.g., a flexible linker, may be included between the bone-targeting moiety and the NP. For example, FIG. 27 provides polypeptides having a linker or both a bone-targeting moiety and a linker (SEQ ID NOs: 128-150); FIGS. 31A-31B provide polypeptides having a linker or both a bone-targeting moiety and a linker, where X in any one of SEQ ID NOs: 173-220 can be any amino acid, e.g., F, L, I, T, E, R, Y, C, P, or D; and FIG. 32 provides amino acid sequences for particular variants, where X in SEQ ID NOs: 186-198 is a leucine to provide the sequences in SEQ ID NOs: 221-233.

The NP polypeptide can include any NPs, N-terminal extensions, C-terminal extensions, and/or linkers described herein. For example, the italicized regions in FIGS. 30, 31A-31B, and 32 may be used as for any of the NPs disclosed herein (see, e.g., SEQ ID NOs: 511-516 and 553-558).

NP Fusion Polypeptides

Any of the NPs, linkers, and Fc regions described herein may be combined in a fusion polypeptide, e.g., a recombinant fusion polypeptide, that includes the structure X-Fc-Y-NP-Z or the structure X-NP-Y-Fc-Z, wherein each of X, Y (the linker region), and Z is absent or is an amino acid sequence of at least one amino acid.

FIGS. 17A-17E depict several possible schematic structures of fusion polypeptides as described herein. Fc-NP or NP-Fc homodimers may be formed, e.g., due to disulfide bonds formed by Fc (FIGS. 17A and 17B, respectively). Alternative, monomer-dimer hybrids are possible in which an NP-Fc or Fc-NP fusion polypeptide is joined to a free Fc domain (FIGS. 17C and 17D, respectively). Furthermore, an NP-Fc monomer may be joined to an Fc-NP monomer, as shown in FIG. 17E. These configurations not intended to be exhaustive but are merely exemplary.

Exemplary fusion polypeptides having an N-terminal NP domain and a C-terminal Fc domain include those shown in FIG. 25A and include CNP-16AAlinker-Fc-His$_{10}$ (NC1) (SEQ ID NO: 521); CNP-6AAlinker-Fc-His$_{10}$ (NC3) (SEQ ID NO: 522); CNP-6AAlinker-Fc (SEQ ID NO: 523); CDNP-Fc (SEQ ID NO: 524), which has no linker between the CDNP and Fc moieties; CDNP-A17saa-Fc (SEQ ID NO: 525), which has a mutation to alanine at position 17 of the CNP22 region and mutations S3, A4, and A5 in the DNP tail region; and CDNP-A17sra-Fc (SEQ ID NO: 526), which has a mutation to alanine at position 17 of the CNP22 region and mutations S3 and A5 in the DNP tail region. FIG. 25B is a listing of the nucleic acid sequence (SEQ ID NO: 806) of NC1.

The NP domain in the fusion polypeptide can be any NP described herein. For example, any of the molecules shown in FIGS. 30, 31A-31B, and 32, with or without the bone-targeting moiety, may be fused to an Fc domain and may optionally further include a linker region between the Fc and NP, as disclosed herein. For example, a CNP variant with M17X mutation can be fused to an Fc domain, e.g., as shown in FIGS. 33A-33E, where X can be any amino acid, e.g., F, L, I, T, E, R, Y, C, P, D, G, A, S, V, W, N, Q, H, or K, e.g., F, L, I, T, E, R, Y, C, P, or D, e.g., F or L. In some embodiments, the sequence is SEQ ID NO: 530, and X is any amino acid described herein, e.g., F, L, I, T, E, R, Y, C, P, D, G, A, S, V, W, N, Q, H, or K, e.g., F, L, I, T, E, R, Y, C, P, or D, e.g., F or L.

In the structure X-Fc-Y-NP-Z or the structure X-NP-Y-Fc-Z, X may include one or more (e.g., 2, 3, 4, 5, 6, 7, 8, 9, 10, 11, 12, 13, 14, 15, 16, 17, 18, 19, 20, 25, 30, 35, 40, 45, 50, or more) additional amino acid residues at the N-terminus of the polypeptide, and Z may independently include one or more (e.g., 2, 3, 4, 5, 6, 7, 8, 9, 10, 11, 12, 13, 14, 15, 16, 17, 18, 19, 20, 25, 30, 35, 40, 45, 50, or more) additional amino acid residues at the C-terminus of the polypeptide.

In some embodiments, the polypeptide includes a bone-targeting moiety, e.g., having a series of consecutive Asp or Glu residues, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$. The bone-targeting moiety, if present, may be positioned anywhere in the fusion polypeptide, e.g., at or near the N-terminal or C-terminal end, and/or in the linker region. For example, any one of X, Y, and/or Z may include a bone-targeting moiety.

In some instances, one or more amino acid residues are introduced into the fusion polypeptide, e.g., within X, Y, or Z, as a result of the cloning strategy used. In some embodiments, any such additional amino acid residues, when incorporated into the polypeptide of the invention, do not provide a cleavage site for endoproteases of the host cell. The likelihood that a designed sequence would be cleaved by the endoproteases of the host cell can be predicted as described, e.g., by Ikezawa (*Biol. Pharm. Bull.* 25:409-417, 2002), hereby incorporated by reference.

In certain embodiments, the fusion polypeptides of the invention are associated into dimers, e.g., through two disulfide bonds located in the hinge regions of the Fc fragments.

In some embodiments, the fusion polypeptides of the invention have at least, e.g., 1, 1.5, 2, 2.5, 3, 3.5, 4, 5, 6, 7, 8, 9, 10, 12.5, 15, 20, 25, 30, 35, 40, 45, 50, 75, 100, 125, 150, 175, 200, 250, 300, 350, 400, 450, 500, 600, 700, 800, 900, 1,000, 1,500, 2,000, 3,000, 4,000, 5,000, 7,500, 10,000, 15,000, 20,000, 25,000, 30,000, 40,000, or 50,000 times the half-life of CNP22 in vivo.

Any NP fusion protein may be expressed with an N-terminal signal sequence to facilitate secretion, e.g., amino acid residues 1-25 of SEQ ID NO: 501, or any other signal sequence known in the art. Such sequences are generally cleaved co-translationally, resulting in secretion of the mature version of the protein.

A fusion polypeptide as described herein may have at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to any of the fusion polypeptides described herein, e.g., SEQ ID NOs: 501-608. In addition, a fusion polypeptide as described herein may have 1, 2, 3, 4, 5, 6, 7, 8, 9, 10, 11, 12, 13, 14, 15, 16, 17, 18, 19, 20, 25, 30, 35, 40, 50, or more additions, deletions, or substitutions relative to any of the fusion polypeptides described herein. Furthermore, in some embodiments, a fusion polypeptide as described herein may be encoded by a nucleic acid molecule that hybridizes under high stringency conditions to at least a portion, e.g., to 20%, 30%, 40%, 50%, 60%, 70%, 75%, 80%, 85%, 90%, 95%, 96%, 97%, 98%, 99%, or even 100%, of a nucleic acid molecule that encodes any of the polypeptides, e.g., fusion polypeptides, described herein.

Fusion proteins include those having one or more modifications that are cleaved during expression. For example, an Fc-CNP fusion protein was designed as shown in FIGS. 18A and 18B. This protein, termed "NC2 Streptag" or "NC2st," has a 25-amino acid N-terminal signal sequence that is cleaved during expression. The mature protein has the following domain structure, from N terminus to C terminus: Strep-tag II sequence (to facilitate purification) flanked by short linker sequences; TEV protease cleavage sequence, followed by a short linker; Fc domain of human IgG-1; 16-amino acid glycine-rich linker; and CNP22. This protein can be produced by chemically synthesizing the coding sequence (FIG. 18C, SEQ ID NO: 801) and inserting the coding sequence into a small cloning plasmid using standard techniques known in the art.

Fusion proteins may be varied in several respects. For example, NC2st can be varied by eliminating the sequence that is N-terminal to the Fc domain (resulting, e.g., in NC2B, as shown in FIGS. 19A-19B), adding a bone-targeting moiety (resulting, e.g., in D10-NC2, as shown in FIG. 19A), and/or altering of the length of the linker between Fc and CNP22 (e.g., NC2B-22 (also referred to as NC2-22), NC2B-28 (also referred to as NC2-28), and NC2B-34 (also referred to as NC2-34), as shown in FIGS. 20A-20D). Other exemplary NC2st variants are shown in FIG. 21 (NC2-KGANKK and NC2-KGANQK) and FIG. 22 (NC2-CNP53mut2).

NC2B may be varied in several respects, including having a point mutation, e.g., at position 17 relative to CNP22, having a bone-targeting moiety, and/or having modified or altered linker regions. Exemplary fusion protein include any sequences having a modified or altered linker region (e.g., SEQ ID NOs: 511-516, as shown in FIG. 34A), as compared to NC2B (as shown in FIGS. 16A-16B); any sequences having a bone-targeting moiety, e.g., a $D_{10}$ moiety (e.g., SEQ ID NOs: 553-558, as shown in FIG. 34B); any N-terminal extensions, C-terminal extensions, and/or linkers for any of the NPs disclosed herein (e.g., the italicized regions in SEQ ID NOs: 511-516 and 553-558, as shown in FIGS. 30, 31A-31B, and 32); any sequences having a phenylalanine (Phe, F) substitution at position 17 relative to CNP22 (e.g., SEQ ID NOs: 559-564, as shown in FIG. 34C), including those sequences having a further modification of a $D_{10}$ bone-targeting moiety at the N-terminus (e.g., SEQ ID NOs: 565-570, as shown in FIG. 34D); any sequences having a leucine (Leu, L) substitution at position 17 relative to CNP22 (e.g., SEQ ID NOs: 571-576, as shown in FIG. 34E), including those sequences having a further modification of a $D_{10}$ bone-targeting moiety at the N-terminus (e.g., SEQ ID NOs: 577-582, as shown in FIG. 34F); any sequences having an arginine (Arg, R) substitution at position 17 relative to CNP22 (e.g., SEQ ID NOs: 583-588, as shown in FIG. 34G), including those sequences having a further modification of a $D_{10}$ bone-targeting moiety at the N-terminus (e.g., SEQ ID NOs: 589-594, as shown in FIG. 34H); and any sequences having a tyrosine (Tyr, Y) substitution at position 17 relative to CNP22 (e.g., SEQ ID NOs: 595-600, as shown in FIG. 34I), including those sequences having a further modification of a $D_{10}$ bone-targeting moiety at the N-terminus (e.g., SEQ ID NOs: 601-606, as shown in FIG. 34J).

Additional constructs include fusion proteins in which an N-terminal Fc domain is fused to a variant of CNP53 with a short $Gly_3$ linker region. An alternative way to analyze these fusion polypeptides is that the linker region is $Gly_3$ followed by amino acid residues 1-31 of CNP53 (or variants thereof); viewed in this way, the linker region connects the Fc domain to CNP22 and is 34 amino acid residues in length. For Fc-CNP53-A (also referred to as "Fc-CNP53 wt") (SEQ ID NOs: 517 (with signal sequence) and 518 (without signal sequence); FIG. 23), position 48 of CNP53, corresponding to position 17 of CNP22, was mutated to alanine. Fc-CNP53-AAA (also referred to as "Fc-CNP53mut") (SEQ ID NOs: 519 (with signal sequence) and 520 (without signal sequence); FIG. 23) has the same sequence as Fc-CNP53-A with the exception that residues 30 and 31 of CNP53, the two residues immediately before CNP22, are mutated to alanine in order to reduce the likelihood of proteolytic cleavage. In some cases, modifying the linker region of an Fc-CNP22 fusion to include the first 31 amino acid residues of CNP53 could result in constructs having even greater potency and efficacy than NC2st in in vitro membrane and whole cell assays.

Additional Polypeptide Features

The polypeptides of the invention also include any polypeptide having one or more post-translational modifications such as glycosylation (e.g., mannosylation and other forms of glycosylation discussed herein), acetylation, amidation, blockage, formylation, gamma-carboxyglutamic acid hydroxylation, methylation, ubiquitination, phosphorylation, pyrrolidone carboxylic acid modification, and sulfation. Artificial modifications, e.g., pegylation, may also be made.

Production of Nucleic Acids and Polypeptides

The nucleic acids and polypeptides of the invention can be produced by any method known in the art. Typically, a nucleic acid encoding the desired fusion protein is generated using molecular cloning methods, and is generally placed within a vector, such as a plasmid or virus. The vector is used to transform the nucleic acid into a host cell appropriate for the expression of the fusion protein. Representative methods are disclosed, for example, in Maniatis et al. (Cold Springs Harbor Laboratory, 1989). Many cell types can be used as appropriate host cells, although mammalian cells are preferable because they are able to confer appropriate post-translational modifications. For example, Human Embryonic Kidney 293 (HEK293) cells have been used as a host for expressing the fusion proteins of the present invention, as described in more detail in the Examples below.

The polypeptides of the invention can be produced under any conditions suitable to effect expression of the polypeptide in the host cell. Such conditions include appropriate selection of a media prepared with components such as a buffer, bicarbonate and/or HEPES, ions like chloride, phosphate, calcium, sodium, potassium, magnesium, iron, carbon sources like simple sugars, amino acids, potentially lipids, nucleotides, vitamins and growth factors like insulin; regular commercially available media like alpha-MEM, DMEM, Ham's-F12, and IMDM supplemented with 2-4 mM L-glutamine and 5% Fetal bovine serum; regular commercially available animal protein free media like Hyclone™ SFM4-CHO, Sigma CHO DHFR⁻, Cambrex POWER™ CHO CD supplemented with 2-4 mM L-glutamine. These media are desirably prepared without thymidine, hypoxanthine and L-glycine to maintain selective pressure, allowing stable protein-product expression.

Additional details of the production of the polypeptides and nucleic acids of the invention are given in the Examples.

Therapeutic Applications

The polypeptides and nucleic acid molecules described herein can have a wide variety of therapeutic applications, e.g., in the fields of neurocutaneous syndromes (e.g., neurofibromatosis) or disorders associated with overactivation of FGFR3 (e.g., bone and cartilage disorders, e.g., achondroplasia, or cancers, e.g., multiple myeloma) or bone or cartilage disorders (e.g., that are not associated with overactivation of FGFR3) or vascular smooth muscle disorders. In addition, the polypeptides and nucleic acid molecules described herein can be used for any condition or disorder that would benefit from elongation of bone.

Neurocutaneous Syndromes

The polypeptides and nucleic acid molecules described herein can be used to treat any disorder, disease, or other abnormality associated with elevated blood and/or urine levels of inorganic pyrophosphate ($PP_i$) and/or overactivation of MAP kinase, such as neurocutaneous syndromes. In particular embodiments, the polypeptide and nucleic acid molecules are used to treat a neurocutaneous syndrome either with or without a bone manifestation. Exemplary neurocutaneous syndromes include neurofibromatosis (e.g., any type described herein, such as type I or type II); Noonan syndrome-like disorder with loose anagen hair; Noonan syndrome-like disorder with juvenile myelomonocytic leukemia (JMML); tuberous sclerosis; Sturge-Weber disease; ataxia telangiectasia; von Hippel-Lindau disease; incontinentia pigmenti; epidermal nevus syndromes, such as linear sebaceous nevus of Jadassohn; nevoid basal cell carcinoma syndrome; hypomelanosis of Ito; neurocutaneous melanosis; Klippel-Ternaunay syndrome; and Waardenburg syndrome, including types I, II, III, and IV.

Neurofibromatosis

Neurofibromatosis is an autosomal dominant neurocutaneous syndrome characterized by abnormal growth or proliferation of nerve tissue, such as to produce tumors (or neurofibromas) or abnormal pigmentation (e.g., café au lait spots). In particular, neurofibromatosis can be accompanied by bone manifestations (e.g., manifestations arising from hypophosphatasia), such as short stature, scoliosis, osteomalacia, osseous fibrous dysplasia (e.g., one or more lesions at the ends of or within one or more bones, such as the femur, tibia, or fibula), pseudarthrosis (e.g., tibial pseudarthrosis), and/or skeletal dysplasia (e.g., tibial dysplasia, orbital dysplasia, and/or sphenoid wing dysplasia).

Neurofibromatosis, or any of its manifestations or phenotypes, can be treated using the compositions and methods described herein. Examples of such disorders, manifestations, and phenotypes include the classic von Recklinghausen type (type I), either with gastrointestinal stromal tumors (i.e., as in intestinal neurofibromatosis (type 3B)) or without such tumors; an acoustic neuroma type (type II); a mixed type that combines the features of types I and II with predominant features, such as bilateral acoustic neuromas, posterior fossa and upper cervical meningiomas, and spinal/paraspinal neurofibromas (type III, Riccardi type or type 3A); an atypical type that is distinguished from by the lack of iris Lisch nodules that are characteristic of type I (type VI); segmental neurofibromatosis, which is a variant of type I having lesions affecting a specific area of the body, such as a single segment of the body or an area that crosses the midline (type V); a type having only the symptoms of café au lait spots without other manifestations of neurofibromatosis (type VI); familial spinal neurofibromatosis, which is caused by mutation in the neurofibromin gene NF1 and considered a distinguishable variant of type I; other variants of type I, such as neurofibromatosis-pheochromocytoma-duodenal carcinoid syndrome; neurofibromatosis with manifestations of Noonan syndrome, such as short stature, ptosis, midface hypoplasia, webbed neck, learning disabilities, and muscle weakness; and schwannomatosis, where any of these disorders can include or exclude one or more bone manifestations.

Disorders Associated with Overactivation of RAS and/or ERK

Any disorder, disease, or other abnormality that is caused by, or is associated with, overactivation of RAS and/or ERK may be treated using the compositions and methods described herein. These disorders, diseases, and other abnormalities include, without limitation, Noonan syndrome, Costello syndrome, Noonan syndrome with multiple lentigines/LEOPARD syndrome, neurofibromatosis type 1, NF1-Noonan syndrome, hereditary gingival fibromatosis type 1, capillary malformation-AV malformation syndrome, Legius syndrome, Noonan syndrome-like disorder with loose anagen hair, Noonan syndrome-like disorder with juvenile myelomonocytic leukemia (JMML), cardio-facio-cutaneous syndrome, or autoimmune lymphoproliferative syndrome, where any of these disorders can include or exclude one or more bone manifestations.

Disorders Associated with Overactivation of FGFR3

Any disorder, disease, or other abnormality that is caused by, or is associated with, overactivation of FGFR3, e.g., stemming from a gain-of-function FGFR3 mutation, may be treated using the compositions and methods described herein. These disorders, diseases, and other abnormalities include, without limitation, bone or cartilage disorders and cancers, each of which is described in more detail below.

Bone or Cartilage Disorders Associated with Overactivation of FGFR3

Any disorder, disease, or other abnormality, e.g., skeletal dysplasia, that affects the function, structure, or growth of bone or cartilage, may be treated using the compositions and methods described herein. In particular, the disorder may be a skeletal dysplasia that is associated with overactivation of FGFR3, such as achondroplasia, including severe achondroplasia with developmental delay and acanthosis; Muenke syndrome (Muenke coronal craniosynostosis); Crouzonodermoskeletal syndrome; hypochondroplasia; thanatophoric dysplasia type I; and thanatophoric dysplasia type II. The compositions and methods of the invention can also be used to treat bone or cartilage disorders not associated with overactivation of FGFR3, and these disorders are described in more detail below.

Cancers

Any cancer that is caused by, or is associated with, overactivation of FGFR3, may be treated using the compositions and methods described herein. These cancers include, e.g., multiple myeloma, myeloproliferative syndromes, leukemia (e.g., plasma cell leukemia), lymphomas, glioblastoma, prostate cancer, bladder cancer, and mammary cancer.

Bone or Cartilage Disorders

The polypeptides and nucleic acid molecules described herein can be used to treat any disorder, disease, phenotype, or other abnormality that affects the function, structure, or growth of bone or cartilage. These bone or cartilage disorders may be, but do not necessarily have to be, associated with overactivation of FGFR3.

Exemplary bone or cartilage disorders include skeletal dysplasia and any other disorders, diseases, phenotypes, or other abnormalities related to the bone or cartilage, including achondroplasia (e.g., homozygous or heterozygous achondroplasia), achondrogenesis, acrodysostosis, acromesomelic dysplasia, atelosteogenesis, bone pain, calcium pyrophosphate dihydrate (CPPD) crystal deposition, camptomelic dysplasia, chondrodysplasia punctata (e.g., rhizomelic type of chondrodysplasia punctata), cleidocranial dysostosis, congenital short femur, craniosynostosis (e.g., Muenke syndrome, Crouzon syndrome, Apert syndrome, Jackson-Weiss syndrome, Pfeiffer syndrome, or Crouzonodermoskeletal syndrome), dactyly (e.g., brachydactyl), camptodactyl), polydactyl), or syndactyly), diastrophic dysplasia, dental disorders (e.g., decrease in teeth mineralization and premature loss of deciduous teeth, such as through aplasia, hypoplasia or dysplasia of the dental cementum), dwarfism, dyssegmental dysplasia, enchondromatosis, fibrochondrogenesis, fibrous dysplasia, hereditary multiple exostoses, hypochondroplasia, hypophosphatasia (HPP) (e.g., infantile HPP, childhood HPP, perinatal HPP, adult HPP, or odontohypophosphatasia), HPP-related seizure, hypophosphatemic rickets, incomplete bone mineralization, Jaffe-Lichtenstein syndrome, Kniest dysplasia, Kniest syndrome, Langer-type mesomelic dysplasia, Marfan syndrome, McCune-Albright syndrome, micromelia, metaphyseal dysplasia (e.g., Jansen-type metaphyseal dysplasia), metatrophic dysplasia, Morquio syndrome, Nievergelt-type mesomelic dysplasia, neurofibromatosis (e.g., type 1, e.g., with bone manifestations or without bone manifestations; type 2; or schwannomatosis), osteoarthritis, osteochondrodysplasia, osteogenesis imperfecta (e.g., perinatal lethal type of osteogenesis imperfecta), osteomalacia, osteopetrosis, osteopoikilosis, osteoporosis, peripheral dysostosis, Reinhardt syndrome, Roberts syndrome, Robinow syndrome, short-rib polydactyly syndromes, short stature, spondyloepiphyseal dysplasia congenita, spondyloepimetaphyseal dysplasia, or thanatophoric dysplasia. Bone or cartilage disorders also include those that can be diagnosed, for example, by elevated blood and/or urine levels of one or more clinical markers related to hypophosphatasia (e.g., elevated levels of inorganic pyrophosphate ($PP_i$), phosphoethanolamine (PEA), and/or pyridoxal 5'-phosphate (PLP)), growth retardation with a decrease of long bone length (such as femur, tibia, humerus, radius, ulna), a decrease of the mean density of total bone, or a decrease of bone mineralization in bones such as femur, tibia, ribs and metatarsi, and phalange. Without being so limited, treatment of bone or cartilage disorders may be observed by one or more of the following: an increase of long bone length, an increase of mineralization in bone and/or teeth, a correction of bowing of the legs, a reduction of bone pain, and a reduction of CPPD crystal deposition in joints.

Skeletal Dysplasia

Skeletal dysplasias are bone or cartilage disorders characterized by short stature or dwarfism. Skeletal dysplasias are typically congenital and may include numerous abnormalities in addition to short stature, e.g., short limbs and trunk; bowlegs; a waddling gait; skull malformations, e.g., a large head, cloverleaf skull, craniosynostosis (premature fusion of the bones in the skull), or wormian bones (abnormal thread-like connections between the bones in the skull); anomalies of the hands and feet, e.g., polydactyly (extra fingers), "hitchhiker" thumbs, and abnormal fingernails and toenails; or chest anomalies, e.g., pear-shaped chest or narrow thorax. Non-skeletal abnormalities may also be present in individuals having skeletal dysplasia, e.g., anomalies of the eyes, mouth, and ears, such as congenital cataracts, myopia, cleft palate, or deafness; brain malformations, such as hydrocephaly, porencephaly, hydranencephaly, or agenesis of the corpus callosum; heart defects, such as atrial septal defect, patent ductus arteriosus, or transposition of the great vessels; developmental delays; or mental retardation. Skeletal dysplasias associated with overactivation of FGFR3 include achondroplasia.

Skeletal dysplasias include achondroplasia (e.g., homozygous or heterozygous achondroplasia), achondrogenesis, acrodysostosis, acromesomelic dysplasia, atelosteogenesis, camptomelic dysplasia, chondrodysplasia punctata (e.g., rhizomelic type of chondrodysplasia punctata), cleidocranial dysostosis, congenital short femur, craniosynostosis (e.g., Muenke syndrome, Crouzon syndrome, Apert syndrome, Jackson-Weiss syndrome, Pfeiffer syndrome, or Crouzonodermoskeletal syndrome), dactyly (e.g., brachydactyl), camptodactyl), polydactyl), or syndactyly), diastrophic dysplasia, dwarfism, dyssegmental dysplasia, enchondromatosis, fibrochondrogenesis, fibrous dysplasia, hereditary multiple exostoses, hypochondroplasia, hypophosphatasia (HPP) (e.g., infantile HPP, childhood HPP, perinatal HPP, adult HPP, or odontohypophosphatasia), hypophosphatemic rickets, Jaffe-Lichtenstein syndrome, Kniest dysplasia, Kniest syndrome, Langer-type mesomelic dysplasia, Marfan syndrome, McCune-Albright syndrome, micromelia, metaphyseal dysplasia (e.g., Jansen-type metaphyseal dysplasia), metatrophic dysplasia, Morquio syndrome, Nievergelt-type mesomelic dysplasia, neurofibromatosis (e.g., type 1, e.g., with bone manifestations or without bone manifestations; type 2; or schwannomatosis), osteoarthritis, osteochondrodysplasia, osteogenesis imperfecta (e.g., perinatal lethal type of osteogenesis imperfecta), osteopetrosis, osteopoikilosis, peripheral dysostosis, Reinhardt syndrome, Roberts syndrome, Robinow syndrome, short-rib polydactyly syndromes, short stature, spondyloepiphyseal dysplasia congenita, spondyloepimetaphyseal dysplasia, or thanatophoric dysplasia.

In particular, some forms of craniosynostosis are the result of mutations in one of the fibroblast growth factor receptors (e.g., one or more of FGFR1, FGFR2, or FGFR3) that cause the activation of the MAPK pathway. This is the case for Muenke (Muenke coronal craniosynostosis), Crouzon, Apert, Jackson-Weiss, Pfeiffer, and Crouzonodermoskeletal syndromes, for example. There is genetic and biochemical evidence in the scientific literature that agents that can prevent activation of the MAP-kinase (ERK 1/2) can prevent craniosynostosis in animal models. In particular, use of a MEK1/2 inhibitor (e.g., U0126), which prevents activation of ERK1/2 can prevent craniosynostosis in an animal model of Apert syndrome (Shukla et al., Nat. Genet. 39:1145, 2007). Accordingly, the compounds of the present invention, which can prevent activation of the MAP-kinase pathway, could be used to treat these forms of craniosynostosis.

Achondroplasia

Achondroplasia is an autosomal dominant skeletal dysplasia that is the most common cause of dwarfism in humans. Its incidence is approximately 1 in 20,000 live births. Skeletal manifestations include growth retardation (with an average adult height of 123-131 cm (4 feet ½ in.-4 feet 3½ in.)), skull deformities, and orthodontic defects. Extraskeletal manifestations include cervical cord compression (with risk of death, e.g., from central apnea or seizures); spinal stenosis (e.g., leg and lower back pain); hydrocephalus (e.g., requiring cerebral shunt surgery); hearing loss due to chronic otitis; cardiovascular disease; neurological disease; higher frequency of accidents; and obesity.

Babies are often diagnosed at birth. While the homozygous form is usually lethal, individuals diagnosed with the heterozygous form have a life expectancy, on average, of 15 years less than the normal population.

Heterozygous or homozygous achondroplasia, or any of its manifestations or phenotypes, can be treated using the compositions and methods described herein. Treatment of either form may be started as early as possible in the patient's life, e.g., shortly after birth, or even in utero; this is particularly important for treatment of the homozygous form, which is typically much more severe and is often lethal if untreated.

Hypophosphatasia (HPP)

HPP is a matrix mineralization disorder that is historically classified according to age at diagnosis and includes (in order from most severe to least severe) perinatal, infantile, childhood, adult, and odontohypophosphatasia forms. The most severe form, perinatal (lethal) HPP, is manifest as an almost complete absence of bone mineralization in utero and can cause stillbirth. Some neonates with perinatal HPP may survive for several days, but suffer increased respiratory compromise due to hypoplastic and rachitic disease of the chest. In infantile HPP, diagnosed before 6 months-of-age, postnatal development seems normal until the onset of poor feeding, inadequate weight gain, and appearance of rickets. Infantile HPP has characteristic radiological features showing impaired skeletal mineralization, sometimes with progressive skeletal demineralization leading to rib fractures and chest deformity. Childhood HPP has highly variable clinical expression. One symptom of childhood HPP is the premature loss of deciduous teeth resulting from aplasia, hypoplasia or dysplasia of dental cementum that connects the tooth root with the periodontal ligament. Another symptom of childhood HPP is rickets, which causes short stature and skeletal deformities such as bowed legs and enlarged wrists, knees and ankles as a result of flared metaphysis. Adult HPP usually presents during middle age, but is frequently preceded by a history of rickets and/or early loss of teeth followed by good health during adolescence and young adult life. In adult HPP, recurrent metatarsal stress fractures are common, and calcium pyrophosphate dihydrate deposition can cause attacks of arthritis and pyrophosphate arthropathy. Finally, odontohypophosphatasia is diagnosed when the only clinical abnormality is dental disease, and radiological studies and even bone biopsies reveal no signs of rickets or osteomalacia.

The more severe clinical forms of HPP are usually inherited as autosomal recessive traits, with parents of such patients showing subnormal levels of serum AP activity. For the milder forms of HPP, i.e., adult HPP and odontohypophosphatasia, an autosomal dominant pattern of inheritance has also been documented.

In the healthy skeleton, TNALP is an ectoenzyme present on the surface of the plasma membrane of osteoblasts and chondrocytes, and on the membranes of their shed matrix vesicles (MVs), where the enzyme is particularly enriched. Deposition of hydroxyapatite during bone mineralization normally initiates within the lumen of these MVs. Electron microscopy has shown that TNALP-deficient MVs from severely affected HPP patients and Akp2$^{-/-}$ mice (a TNALP null mouse model, see below) contain hydroxyapatite crystals, but that extravesicular crystal propagation appears retarded. This defect is attributed to the extracellular accumulation of PP$_i$, a potent inhibitor of calcification, due to a deficiency of TNALP activity.

At physiological concentrations (0.01-0.1 mM), PP$_i$ has the ability to stimulate mineralization. This has been demonstrated in organ-cultured chick femurs and in isolated rat MVs. However, at concentrations above 1 mM, PP$_i$ inhibits calcium phosphate mineral formation by coating hydroxyapatite crystals, thus preventing mineral crystal growth and proliferative self-nucleation. Thus, PP$_i$ has a dual physiological role: it functions as a promoter of mineralization at low concentrations but as an inhibitor of mineralization at higher concentrations. TNALP has been shown to hydrolyze the mineralization inhibitor PP$_i$ to facilitate mineral precipitation and growth. Recent studies using the Akp2$^{-/-}$ mice have indicated that the primary role of TNALP in vivo is to restrict the size of the extracellular PP$_i$ pool to allow proper skeletal mineralization.

The severity of hypophosphatasia depends on the nature of the TNALP mutation. Missense mutations at a variety of positions in TNALP, including the enzyme's active site vicinity, homodimer interface, crown domain, amino-terminal arm, and calcium-binding site, have all been found to affect its catalytic activity. In addition, missense, nonsense, frame-shift, and splice site mutations have also been shown to lead to aberrant mutant proteins or intracellular trafficking defects that lead to subnormal activity on the cell surface. The multitude of mutations that cause HPP, and the fact that compound heterozygosity is a common occurrence in HPP, explain the variable expressivity and incomplete penetrance often observed in this disease.

Progress on the human form of HPP has benefited greatly from the existence of the TNALP null mice (Akp2$^{-/-}$), an animal model of HPP. Akp2$^{-/-}$ mice phenocopy infantile HPP remarkably well: they are born with a normally mineralized skeleton but develop radiographically apparent rickets at about 6 days of age, and die between days 12-16 suffering severe skeletal hypomineralization and episodes of apnea and epileptic seizures attributable to disturbances in PLP (vitamin B$_6$) metabolism.

Both PP$_i$ and PLP are confirmed natural substrates of TNALP, and some TNALP active site mutations have been shown to have different effects on the ability of the enzyme to metabolize PP$_i$ and PLP. Abnormalities in PLP metabolism explain the epileptic seizures observed in Akp2$^{-/-}$ mice, while abnormalities in PP$_i$ metabolism explain the skeletal phenotype in this mouse model of HPP.

In any of the methods of the invention, the pharmaceutical compositions described herein are optionally administered in an amount that is therapeutically effective to treat a HPP phenotype selected from the group consisting of HPP-related seizure, premature loss of deciduous teeth, incomplete bone mineralization, elevated blood and/or urine levels of PP$_i$, elevated blood and/or urine levels of PEA, elevated blood and/or urine levels of PLP, inadequate weight gain, rickets, bone pain, calcium pyrophosphate dihydrate crystal deposition, aplasia, hypoplasia, and dysplasia of the dental cementum. In some embodiments, the incomplete bone mineralization is incomplete femoral bone mineralization, incomplete tibial bone mineralization, incomplete metatarsal bone mineralization, or incomplete rib bone mineralization.

Vascular Smooth Muscle Disorders

The polypeptides and nucleic acid molecules described herein can be used to treat any disorder, disease, or other abnormality that affects the function, structure, or growth of vascular smooth muscle. For example, natriuretic peptides modulate salt and water homeostasis in the body and in this way act as regulators of blood pressure. The peptides belonging to this family have varying amino acid sequences and are secreted through different mechanisms by various tissues in the body For example, ANP is released by muscle cells in the upper chambers (atria) of the heart (atrial myocytes) and acts as a vasodilator; BNP is secreted by the lower chambers (ventricles) of the heart in response to cardiac stress; and CNP exerts natruretic and natriuretic effect and regulates vessel tone, inhibits migration and proliferation of vascular smooth muscle cell. Accordingly, the polypeptides and compositions of the invention can be used to treat vascular smooth muscle disorders. Exemplary vascular smooth muscle disorders are hypertension, restenosis, arteriosclerosis, acute decompensated heart failure, congestive heart failure, cardiac edema, nephredema, hepatic edema, acute renal insufficiency, and chronic renal insufficiency.

Conditions for Elongation of Bone

Any condition, disorder, disease, or other abnormality that would benefit from elongation of bone may be treated using the compositions and methods described herein. These conditions, disorders, diseases, and other abnormalities include, without limitation, insufficient or impaired bone growth arising from fractures, renal failure or insufficiency, poor diet, vitamin deficiency, or hormone deficiency. Healthy subjects, e.g., those without any conditions, disorders, diseases, or other abnormalities related to bone or cartilage, may also be treated using the compositions and methods described herein, e.g., for cosmetic purposes.

Skeletal dysplasias are also associated with shortened segments of long bones. Exemplary skeletal dysplasias include those associated with rhizomelia (or shortening in a proximal segment of a limb, e.g., in the humerus or femur), such as achondroplasia, atelosteogenesis, congenital short femur, diastrophic dysplasia, hypochondroplasia, Jansen type of metaphyseal dysplasia, rhizomelic type of chondrodysplasia punctata, spondyloepiphyseal dysplasia congenita, and thanatophoric dysplasia; mesomelia (or shortening in a middle segment of a limb, e.g., in the radius, ulna, tibia, or fibula), such as Langer and Nievergelt types of mesomelic dysplasias, Robinow syndrome, and Reinhardt syndrome; acromelia (or shortening in a distal segment of a limb, e.g., in the metacarpals or phalanges), such as acrodysostosis and peripheral dysostosis; acromesomelia (or shortening in the middle and distal segments of limbs, e.g., in the forearms and hands), such as acromesomelic dysplasia; micromelia (or shortening in the entire limb), such as achondrogenesis, fibrochondrogenesis, dyssegmental dysplasia, Kniest dysplasia, and Roberts syndrome; or short-trunk, such as Dyggve-Melchior-Clausen disease, Kniest syndrome, metatrophic dysplasia, Morquio syndrome, spondyloepimetaphyseal dysplasia, and spondyloepiphyseal dysplasia congenita.

Combination Therapy

The combinations of the polypeptides of the invention (e.g., a combination of an sALP polypeptide and an NP polypeptide, such as a combination of an sALP fusion protein and an NP fusion protein) are useful for the treatment of any disease or condition described herein. Therapy may be performed alone or in conjunction with another therapy (e.g., surgery, radiation therapy, immunotherapy, or gene therapy). Additionally, a person having a greater risk of developing a disease described herein (e.g., one who is genetically predisposed or one who previously had a neurocutaneous syndrome) may receive prophylactic treatment to inhibit or delay disease formation. The duration of the combination therapy depends on the type of disease or disorder being treated, the age and condition of the patient, the stage and type of the patient's disease, and how the patient responds to the treatment. Therapy may be given in on-and-off cycles that include rest periods so that the patient's body has a chance to recovery from any as yet unforeseen side-effects.

The administration of a combination of the polypeptides of the present invention (e.g., a combination of an sALP polypeptide and an NP polypeptide) allows for the administration of lower doses of each polypeptide, providing similar efficacy and lower toxicity compared to administration of either polypeptide alone. Alternatively, such combinations result in improved efficacy in treating a disease described herein (e.g., a neurocutaneous syndrome, such as neurofibromatosis) with similar or reduced adverse events over the single agent alone, at moderate or high doses.

Formulation

Formulation will depend on the route of administration, as well as on other therapeutic goals. The polypeptides and nucleic acid molecules described herein can be administered by any route known in the art, e.g., subcutaneous (e.g., by subcutaneous injection), intravenously, orally, nasally, intramuscularly, sublingually, intrathecally, or intradermally. By way of example, pharmaceutical compositions of the invention can be in the form of a liquid, solution, suspension, pill, capsule, tablet, gelcap, powder, gel, ointment, cream, nebulae, mist, atomized vapor, aerosol, or phytosome.

In some embodiments of the invention, the compositions of the invention can be administered subcutaneously. Subcutaneous administration is advantageous because it is relatively non-invasive and offers desirable pharmacokinetic profiles. Suitable volumes are known to those skilled in the art, and are typically 5 mL or smaller (e.g., 4 mL, 3.5 mL, 3 mL, 2.7 mL, 2.5 mL, 2.3 mL, 2.2 mL, 2.1 mL, 2.0 mL, 1.9 mL, 1.8 mL, 1.7 mL, 1.5 mL, 1.3 mL, 1.0 mL, 0.7 mL, 0.5 mL, 0.3 mL, 0.1 mL, 0.05 mL, 0.01 mL, or smaller). Typically, the compositions of the invention can be formulated at a concentration between 1 mg/mL and 500 mg/mL (e.g., between 10 mg/mL and 300 mg/mL, 20 mg/mL and 120 mg/mL, 40 mg/mL and 200 mg/mL, 30 mg/mL and 150 mg/mL, 40 mg/mL and 100 mg/mL, 50 mg/mL and 80 mg/mL, or 60 mg/mL and 70 mg/mL) for subcutaneous administration.

For oral administration, tablets or capsules can be prepared by conventional means with pharmaceutically acceptable excipients such as binding agents, fillers, lubricants, disintegrants, or wetting agents. The tablets can be coated by methods known in the art. Liquid preparations for oral administration can take the form of, for example, solutions, syrups, or suspension, or they can be presented as a dry product for constitution with saline or other suitable liquid vehicle before use. Compositions of the invention for oral administration also can contain pharmaceutically acceptable excipients such as suspending agents, emulsifying agents, non-aqueous vehicles, preservatives, buffer salts, flavoring, coloring, and sweetening agents as appropriate. Preparations for oral administration also can be suitably formulated to give controlled release of the active ingredients.

Enteric coatings can further be used on tablets of the present invention to resist prolonged contact with the strongly acidic gastric fluid, but dissolve in the mildly acidic or neutral intestinal environment. Without being so limited, cellulose acetate phthalate, Eudragit™ and hydroxypropyl methylcellulose phthalate (HPMCP) can be used in enteric coatings of pharmaceutical compositions of the present invention. Cellulose acetate phthalate concentrations generally used are 0.5-9.0% of the core weight. The addition of plasticizers improves the water resistance of this coating material, and formulations using such plasticizers are more effective than when cellulose acetate phthalate is used alone. Cellulose acetate phthalate is compatible with many plasticizers, including acetylated monoglyceride; butyl phthalylbutyl glycolate; dibutyl tartrate; diethyl phthalate; dimethyl phthalate; ethyl phthalylethyl glycolate; glycerin; propylene glycol; triacetin; triacetin citrate; and tripropionin. It is also used in combination with other coating agents such as ethyl cellulose, in drug controlled-release preparations.

The compounds of the invention may be administered in combination with pharmaceutically acceptable, sterile, aqueous or non-aqueous solvents, suspensions or emulsions. Examples of nonaqueous solvents are propylene glycol, polyethylene glycol, vegetable oil, fish oil, and injectable organic esters. Aqueous carriers include water, water-alcohol solutions, emulsions or suspensions, including saline and buffered medical parenteral vehicles including sodium chloride solution, Ringer's dextrose solution, dextrose plus sodium chloride solution, Ringer's solution containing lactose, or fixed oils. Intravenous vehicles may include fluid and nutrient replenishers, electrolyte replenishers, such as those based upon Ringer's dextrose, and the like.

In some embodiments, the pharmaceutical compositions of the present invention can be delivered in a controlled release system. In some embodiments, polymeric materials including polylactic acid, polyorthoesters, cross-linked amphipathic block copolymers and hydrogels, polyhydroxy butyric acid and polydihydropyrans can be used (see also Smolen and Ball, Controlled Drug Bioavailability, Drug product design and performance, 1984, John Wiley & Sons; Ranade and Hollinger, Drug Delivery Systems, pharmacology and toxicology series, 2003, $2^{nd}$ edition, CRC Press). In another embodiment, a pump may be used (Saudek et al., 1989, N. Engl. J. Med. 321: 574).

The compositions of the invention could be formulated in the form of a lyophilized powder using appropriate excipient solutions (e.g., sucrose) as diluents.

Furthermore, cells can be isolated from an individual having a neurocutaneous syndrome, a disorder associated with overactivation of FGFR3, e.g., achondroplasia, a bone or cartilage disorder, or a vascular smooth muscle disorder or from an individual that would benefit from bone elongation; transformed with a nucleic acid of the invention; and reintroduced to the afflicted individual (e.g., subcutaneous or intravenous injection). Alternatively, the nucleic acid can be administered directly to the afflicted individual, for example, by injection. The nucleic acid can also be delivered through a vehicle such as a liposome, which can be designed to be targeted to a specific cell type, and engineered to be administered through different routes.

The polypeptides or compositions of the present invention may also be used in combination with at least one other active ingredient to correct, e.g., an achondroplasia phenotype, neurofibromatosis, HPP, or any other disorder or condition described herein.

For combination therapy, two or more of the polypeptides of the present invention (e.g., an sALP polypeptide and an NP polypeptide) are formulated in a variety of ways that are known in the art. For example, the first and second polypeptides may be formulated together or separately. In some embodiments, the first and second polypeptides are formulated together for the simultaneous or near simultaneous administration of the polypeptides. Such co-formulated compositions can include the sALP polypeptide and the NP polypeptide formulated together in the same pill, capsule, liquid, etc.

Administration of each compound in controlled release formulations is useful where the sALP polypeptide or the NP polypeptide, has (i) a narrow therapeutic index (e.g., the difference between the plasma concentration leading to harmful side effects or toxic reactions and the plasma concentration leading to a therapeutic effect is small; generally, the therapeutic index, TI, is defined as the ratio of median lethal dose ($LD_{50}$) to median effective dose ($ED_{50}$)); (ii) a narrow absorption window in the gastro-intestinal tract; (iii) a short biological half-life, such as by degradation in vivo by NEP and/or IDE; or (iv) the pharmacokinetic profile of each component must be modified to maximize the exposure of the neoplasm to an amount of each agent, together, that is therapeutically effective. Accordingly, a sustained release formulation may be used to avoid frequent dosing that may be required in order to sustain the plasma levels of both agents at a therapeutic level.

Many strategies can be pursued to obtain controlled release in which the rate of release outweighs the rate of metabolism of the therapeutic polypeptide. For example, controlled release can be obtained by the appropriate selection of formulation parameters and ingredients (e.g., appropriate controlled release compositions and coatings). Examples include single or multiple unit tablet or capsule compositions, oil solutions, suspensions, emulsions, microcapsules, microspheres, nanoparticles, patches, and liposomes. The control release mechanism can be such that the compound of the sALP polypeptide is released first, followed by the NP polypeptide, or vice versa. The release mechanism can also be controlled that the two polypeptides are released at period intervals, the release could be simultaneous or a delayed release of one, when release of a particular drug is preferred over the other.

Controlled release formulations may include a degradable or nondegradable polymer, hydrogel, organogel, or other physical construct that modifies the bioabsorption, half life or biodegradation of the agent. The controlled release formulation can be a material that is painted or otherwise applied onto the afflicted site, either internally or externally. In one example, hydrogels, such as those described in U.S. Pat. No. 5,626,863 can be used in controlled release formulations of compositions of the invention. These biodegradable polymers can be tailored to degrade at a desired rate and with a desired kinetics by selecting the appropriate monomers, method of preparation and molecular weight. Differences in crystallinity of the monomer can alter the polymeric degradation rate. Due to the relatively hydrophobic nature of most polymers, actual mass loss can begin with the oligomeric fragments that are small enough to be water soluble; hence, even the initial molecular weight can influence the degradation rate.

The individually or separately formulated polypeptides can be packaged together as in a kit. Non-limiting examples include kits that contain, e.g., two pills, a pill and a powder, a suppository and a liquid in a vial, two topical creams, among others. The kit can include optional components that aid in the administration of the unit dose to patients, such as vials for reconstituting powder forms, syringes for injection or subcutaneous administration, customized IV delivery systems, inhalers, among others. Additionally, the unit dose kit can contain instructions for preparation and administration of the compositions. The kit may be manufactured as a single use unit dose for one subject, multiple uses for a particular subject (at a constant dose or in which the individual polypeptides may vary in potency as therapy progresses); or the kit may contain multiple doses suitable for administration to multiple subjects ("bulk packaging"). The kit components may be assembled in cartons, blister packs, bottles, tubes, and the like.

Gene Therapy

The polypeptides described herein could also be advantageously delivered through gene therapy, where an exogenous nucleic acid encoding the proteins is delivered to tissues of interest and expressed in vivo. Gene therapy methods are discussed, e.g., in Verme et al. (*Nature* 389: 239-242, 1997), Yamamoto et al. (*Molecular Therapy* 17:S67-S68, 2009), and Yamamoto et al., (*J. Bone Miner. Res.* 26:135-142, 2011), each of which is hereby incorporated by reference. Both viral and non-viral vector systems can be used. The vectors may be, for example, plasmids, artificial chromosomes (e.g., bacterial, mammalian, or yeast artificial chromosomes), virus or phage vectors provided with an origin of replication, and optionally, a promoter for the expression of the nucleic acid encoding the viral polypeptide and optionally, a regulator of the promoter. The vectors may contain one or more selectable marker genes, for example, an ampicillin or kanamycin resistance gene in the case of a bacterial plasmid or a resistance gene for a fungal vector. Vectors may be used in in vitro, for example, for the production of DNA, RNA, or the viral polypeptide, or may be used to transfect or transform a host cell, for example, a mammalian host cell, e.g., for the production of the viral polypeptide encoded by the vector. The vectors may also be adapted to be used in vivo, for example, in a method of vaccination or gene therapy.

Examples of suitable viral vectors include, retroviral, lentiviral, adenoviral, adeno-associated viral, herpes viral, including herpes simplex viral, alpha-viral, pox viral, such as Canarypox and vaccinia-viral based systems. Gene transfer techniques using these viruses are known in the art. Retrovirus vectors, for example, may be used to stably integrate the nucleic acids of the invention into the host genome. Replication-defective adenovirus vectors by contrast remain episomal and therefore allow transient expression. Vectors capable of driving expression in insect cells (e.g., baculovirus vectors), in human cells, yeast, or in bacteria may be employed in order to produce quantities of the viral polypeptide(s) encoded by the nucleic acids of the invention, for example, for use in subunit vaccines or in immunoassays. Useful gene therapy methods include those described in WO 06/060641, U.S. Pat. No. 7,179,903 and WO 01/36620 (each of which is hereby incorporated by reference), which use an adenovirus vector to target a nucleic acid of interest to hepatocytes as protein producing cells.

In an additional example, a replication-deficient simian adenovirus vector may be used as a live vector. These viruses contain an E1 deletion and can be grown on cell lines that are transformed with an E1 gene. Examples of these replication-deficient simian adenovirus vectors are described in U.S. Pat. No. 6,083,716 and WO 03/046124 (each of which is hereby incorporated by reference). These vectors can be manipulated to insert a nucleic acid of the invention, such that the encoded viral polypeptide(s) may be expressed.

Promoters and other expression regulatory signals may be selected to be compatible with the host cell for which expression is designed. For example, mammalian promoters include the metallothionein promoter, which can be induced in response to heavy metals such as cadmium, and the β-actin promoter. Viral promoters, such as the SV40 large T antigen promoter, human cytomegalovirus (CMV) immediate early (1E) promoter, rous sarcoma virus LTR promoter, adenovirus promoter, or a HPV promoter, particularly the HPV upstream regulatory region (URR) may also be used. All these promoters, as well as additional promoters, are well-described in the art.

The nucleic acid molecules described herein may also be administered using non-viral based systems. For example, these administration systems include microsphere encapsulation, poly(lactide-co-glycolide), nanoparticle, and liposome-based systems. Non-viral based systems also include techniques facilitating the delivery of "naked" polynucleotides (such as electroporation, "gene gun" delivery and various other techniques used for the introduction of polynucleotides).

The introduced polynucleotide can be stably or transiently maintained in the host cell. Stable maintenance typically requires that the introduced polynucleotide either contains an origin of replication compatible with the host cell or integrates into a replicon of the host cell such as an extrachromosomal replicon (e.g., a plasmid) or a nuclear or mitochondrial chromosome.

Dosage

Any amount of a polypeptide or a pharmaceutical composition of the invention can be administered to a subject. The dosages will depend on many factors, including the mode of administration and the age of the subject. Typically, the amount of the composition of the invention contained within a single dose will be an amount that is effective to treat a neurocutaneous syndrome, a disorder associated with overactivation of FGFR3, a bone or cartilage disorder, or a vascular smooth muscle disorder, or to elongate bone, without inducing significant toxicity. For example, the polypeptides described herein can be administered to subjects in individual doses ranging, e.g., from 0.01 mg/kg to 500 mg/kg (e.g., from 0.05 mg/kg to 500 mg/kg, from 0.2 mg/kg to 20 mg/kg, from 5 mg/kg to 500 mg/kg, from 0.1 mg/kg to 100 mg/kg, from 10 mg/kg to 100 mg/kg, from 0.1 mg/kg to 50 mg/kg, 0.5 mg/kg to 25 mg/kg, 1.0 mg/kg to 10 mg/kg, 1.5 mg/kg to 5 mg/kg, or 2.0 mg/kg to 3.0 mg/kg) or from 1 μg/kg to 1,000 μg/kg (e.g., from 5 μg/kg to 1,000 μg/kg, from 1 μg/kg to 750 μg/kg, from 5 μg/kg to 750 μg/kg, from 10 μg/kg to 750 μg/kg, from 1 μg/kg to 500 μg/kg, from 5 μg/kg to 500 μg/kg, from 10 μg/kg to 500 μg/kg, from 1 μg/kg to 100 μg/kg, from 5 μg/kg to 100 μg/kg, from 10 μg/kg to 100 μg/kg, from 1 μg/kg to 50 μg/kg, from 5 μg/kg to 50 μg/kg, or from 10 μg/kg to 50 μg/kg). Exemplary doses include, e.g., 0.01, 0.05, 0.1, 0.5, 1, 2, 2.5, 5, 10, 20, 25, 50, 100, 125, 150, 200, 250, or 500 mg/kg; or 1, 2, 2.5, 5, 10, 20, 25, 50, 100, 125, 150, 200, 250, 500, 750, 900, or 1,000 μg/kg. For all dosages or ranges recited herein, the term "about" may be used to modify these dosages by ±10% of the recited values or range endpoints.

Doses can also be adjusted when two or more polypeptides or compositions of the inventions are being administered. Exemplary doses include an sALP polypeptide (e.g., an sALP fusion protein) present in a dosage between about 0.2 mg/kg to about 20 mg/kg and an NP polypeptide (e.g., an NP fusion protein) present in a dosage of about 0.5 mg/kg to about 500 mg/kg. In particular embodiments, the dose of each individual polypeptide or composition is lower than the therapeutic dose of a single polypeptide or single composition when administered alone.

Doses can be administered, e.g., hourly, bihourly, daily, bidaily, twice a week, three times a week, four times a week, five times a week, six times a week, weekly, biweekly, monthly, bimonthly, or yearly. Alternatively, doses can be administered, e.g., twice, three times, four times, five times, six times, seven times, eight times, nine times, 10 times, 11 times, or 12 times per day. In particular embodiments, the dosing regimen is once weekly. The duration of the dosing regimen can be, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 day(s), week(s), or month(s), or even for the remaining lifespan of the subject. The amount, frequency, and duration of dosage will be adapted by the clinician in accordance with conventional factors such as the extent of the disease and different parameters from the subject.

The nucleic acids of the invention can be administered according the formulations described herein to a patient in dosages suitable for gene therapy. The amount of the nucleic acids administered will depend on a number of factors known to those skilled in the art, including: the length and nature of the nucleic acid, the vector (e.g., viral or non-viral) used, the activity of the polypeptide encoded, the presence of excipients, the route and method of administration, and the general condition and fitness of the subject. Exemplary dosages and routes of administration are described, e.g., in Melman et al. (*Isr. Med. Assoc. J.* 9:143-146, 2007; describing the intrapenile injection of 0.5 mg to 7.5 mg of a human cDNA in a plasmid for treating erectile dysfunction), Powell et al. (*Circulation* 118:58-65, 2008; describing the intramuscular injection of 0.4 mg to 4.0 mg of a hepatocyte growth factor plasmid to treat critical limb ischemia, Waddill et al. (*AJR Am. J. Roentgenol.* 169:63-67, 1997; describing the CT-guided intratumoral injection of 0.01 mg to 0.25 mg of plasmid DNA encoding an MHC antigen to treat melanoma), Kastrup et al. (*J. Am. Coll. Cardiol.* 45:982-988, 2005; describing the intramyocardial injection of 0.5 mg of a VEGF plasmid to treat severe angina pectoris), and Romero et al. (*Hum. Gene. Ther.* 15:1065-1076, 2004; describing the intramuscular injection of 0.2 mg to 0.6 mg of a plasmid to treat Duchenne/Becker muscular dystrophy), each of which is hereby incorporated by reference.

In certain embodiments, the nucleic acids of the invention can be administered to the subject at a dose in the range from, e.g., 0.01 mg to 100 mg (e.g., from 0.05 mg to 50 mg, 0.1 mg to 10 mg, 0.3 mg to 3 mg, or about 1 mg) of nucleic acid. The total volume at which the nucleic acid can be administered will depend on its concentration, and can range from, e.g., 1 µL to 10 mL (e.g. from 10 µL to 1 mL, 50 µL to 500 µL, 70 µL to 200 µL, 90 µL to 150 µL, or 100 µL to 120 µL).

The nucleic acids can be administered, e.g., hourly, bihourly, daily, bidaily, twice a week, three times a week, four times a week, five times a week, six times a week, weekly, biweekly, monthly, bimonthly, or yearly. Alternatively, the nucleic acids can be administered, e.g., twice, three times, four times, five times, six times, seven times, eight times, nine times, 10 times, 11 times, or 12 times per day. The duration of the dosing regimen can be, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 day, weeks, or months, or even for the remaining lifespan of the subject.

These are guidelines, since the actual dose should be carefully selected and titrated by an attending physician or nutritionist based upon clinical factors unique to each subject. The optimal periodic dose will be determined by methods known in the art and will be influenced by factors such as the age of the subject, as indicated above, and other clinically relevant factors. In addition, subjects may be taking medications for other diseases or conditions. The other medications may be continued during the time that a polypeptide or nucleic acid of the invention is given to the subject, but it is advisable in such cases to begin with low doses to determine if adverse side effects are experienced.

EXAMPLES

The following examples are provided for the purpose of illustrating the invention and are not meant to limit the invention in any way.

Example 1

Characterization of Osteoblasts in Mice Lacking NF1

To determine the effect of NF1 on bone matrix mineralization, mice lacking NF1 in osteochondroprogenitor cells were developed and characterized. These mice displayed skeletal dysplasia defects similar to patients with neurofibromatosis type I, where these defects included progressive scoliosis and kyphosis, tibial bowing and abnormalities in skull and anterior chest wall formation. In particular, $NF1_{col2}^{-/-}$ osteoblasts secreted increased levels of ($PP_i$) as compared to osteoblasts from wild-type mice (FIG. 1A). Bone marrow adherent stromal cells (BMSCs) extracted from adult $NF1_{col2}^{-/-}$ mice and grown in vitro under osteogenic medium form less alkaline phosphatase (AP)-positive and less mineralized (alizarin red-positive) nodules compared to BMSCs extracted from wild-type mice, which is accompanied by an increased amount of $PP_i$ released in the medium over 24 hours. Accumulation of $PP_i$ prevents proper bone matrix mineralization and likely contributes, at least in part, to defects observed in $NF1_{col2}^{-/-}$ mice. Thus, compounds that reduce PPi accumulation, such as sALP or an sALP analog, could be useful for treating NF1.

Figure 1B:
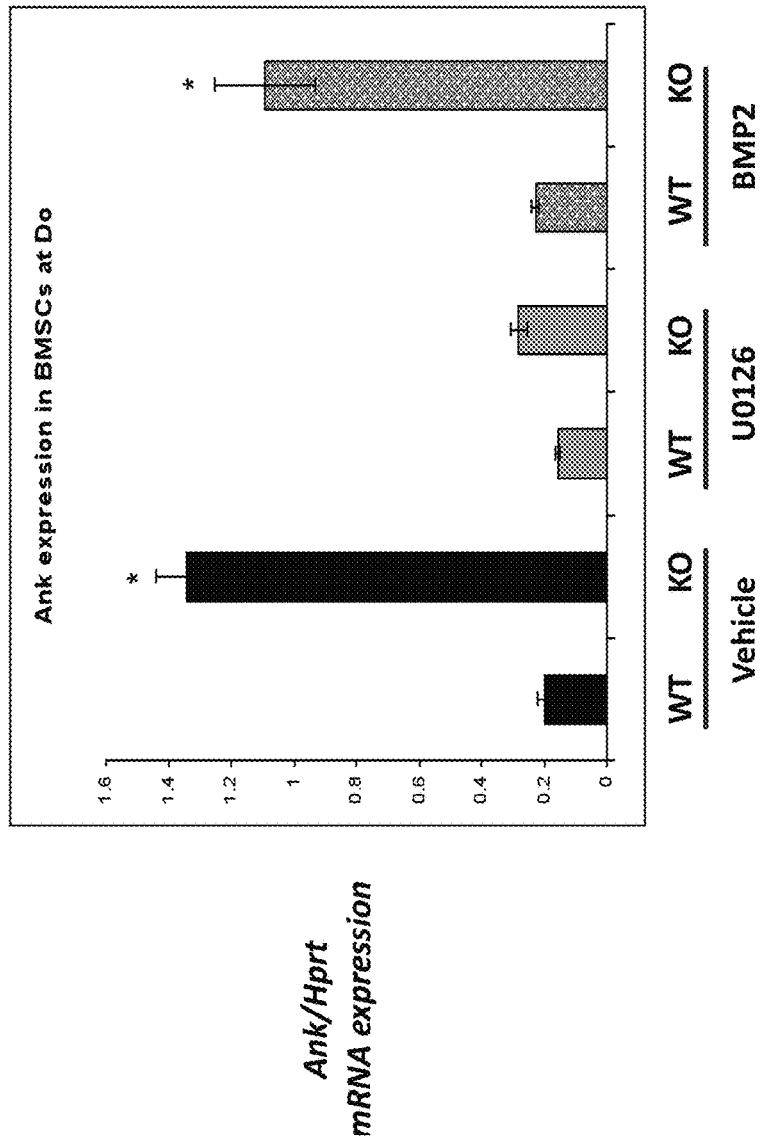
FIG. 1B is a graph showing levels of progressive ankylosis gene (Ank) mRNA expression in osteoblasts from wild-type mice (labeled "WT") and $NF1_{col2}{}^{-/-}$ mice (labeled "KO"). Osteoblasts were treated with vehicle, a MEK1/MEK2 kinase inhibitor U0126 (1,4-diamino-2,3-dicyano-1,4-bis(2-aminophenylthio) butadiene), or bone morphogenetic protein 2 (BMP2).

In addition, $NF1_{col2}^{-/-}$ osteoblasts expressed increased levels of mRNA for the progressive ankylosis gene (Ank) as compared to osteoblasts from wild-type mice (FIG. 1B). Treatment with a dual-specificity MEK1/MEK2 kinase inhibitor (U0126) provided decreased levels of Ank mRNA expression in $NF1_{col2}^{-/-}$ osteoblasts as compared to vehicle, and these observed levels were similar to that in wild-type osteoblasts (FIG. 1B, second and third bars). Thus, compounds that inhibit a kinase pathway, such as NP or an NP analog, could be useful for treating NF1.

Taken together, these data suggest that an sALP polypeptide alone, an NP polypeptide alone, or the combination of both an sALP polypeptide and an NP polypeptide could be useful for treating any neurocutaneous syndrome with bone manifestations, such as neurofibromatosis, or any other disorder described herein.

Example 2

Combination Therapy for the Treatment of Neurofibromatosis

Figure 2:
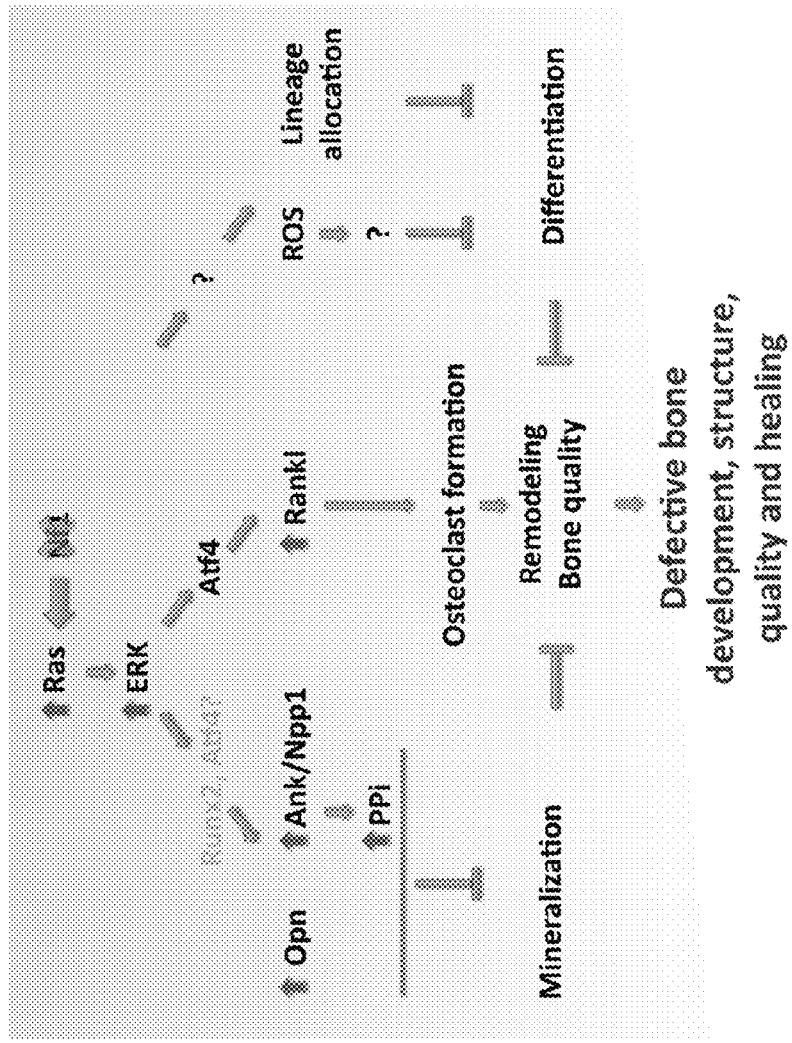
FIG. 2 is a schematic showing a non-limiting, hypothetical working model for defective bone matrix mineralization in $NF1_{col2}{}^{-/-}$ mice.

FIG. 2 provides a hypothetical working model for defective bone matrix mineralization in $NF1_{col2}^{-/-}$ mice, which can include multiple imbalances (e.g., increase of $PP_i$ or overactivation of one or more kinases, such as Ras or ERK) that contribute to the disease. Without wishing to be limited by theory, accumulation of $PP_i$ could be minimized by using any of the compositions and methods described herein including a soluble alkaline phosphatase (sALP) or sALP analog (see, e.g., the polypeptide of SEQ ID NO: 1204). Furthermore, overactivation of one or more kinases could be controlled by using any of the compositions and methods described herein including an NP or NP analog. As described herein, the intracellular production of cGMP resulting from NPR-B activation is known to inhibit the MAP-kinase pathway. Thus, an NP or NP analog that could activate the NPR-B signaling pathway can be used for the treatment of neurocutaneous syndromes, such as neurofibromatosis. Accordingly, the combination of an sALP or sALP analog (e.g., an sALP polypeptide) with an NP or NP analog (e.g., an NP polypeptide) could be particularly useful for treating such diseases.

Example 3

In Vitro and In Vivo Effects of sTNALP-FcD$_{10}$ on NF1$_{col2}^{-/-}$ Phenotype To assess the effect of sALP polypeptides on NF1 phenotype, cultures of osteoblasts from NF1$_{col2}^{-/-}$ mice were treated with either bone morphogenetic protein 2 (BMP2) or the sALP fusion polypeptide of sTNALP-FcD$_{10}$ (SEQ ID NO: 1204).

Both wild-type and NF1$_{col2}^{-/-}$ osteoblasts were treated with increasing concentrations of recombinant human BMP2 (rhBMP2, FIG. 3A). In NF1$_{col2}^{-/-}$ osteoblasts, rhBMP2 rescued the differentiation defect, as evidenced by an increased presence of alkaline phosphatase upon increasing doses of rhBMP2 (FIG. 3A, second row). However, increased mineralization was not observed, as evidenced by the lack of calcium deposition (as indicated by the lack of alizarin red S staining) (FIG. 3A, fourth row).

Figure 3B:
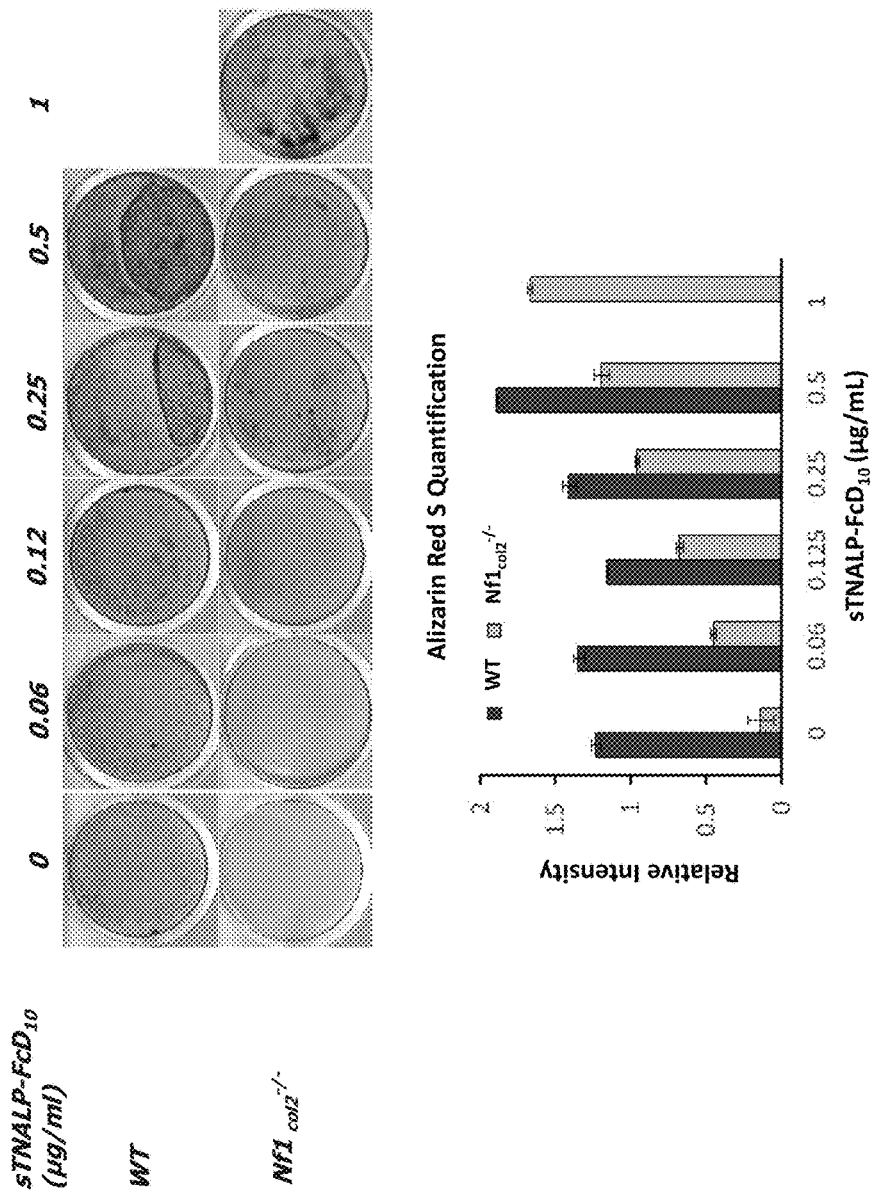
FIG. 3B shows the effect of an sALP fusion polypeptide (sTNALP-$FcD_{10}$, SEQ ID NO: 1204) in bone marrow stromal cells from wild-type mice (labeled "WT") and $NF1_{col2}{}^{-/-}$ mice. Cells were then treated for 8 days with increasing doses of sTNALP-$FcD_{10}$. Cell plates are shown with histological staining for alizarin red S to determine the presence of calcific deposition (top), and the relative intensity of staining with alizarin red S was quantified (bottom).
Figure 3C:
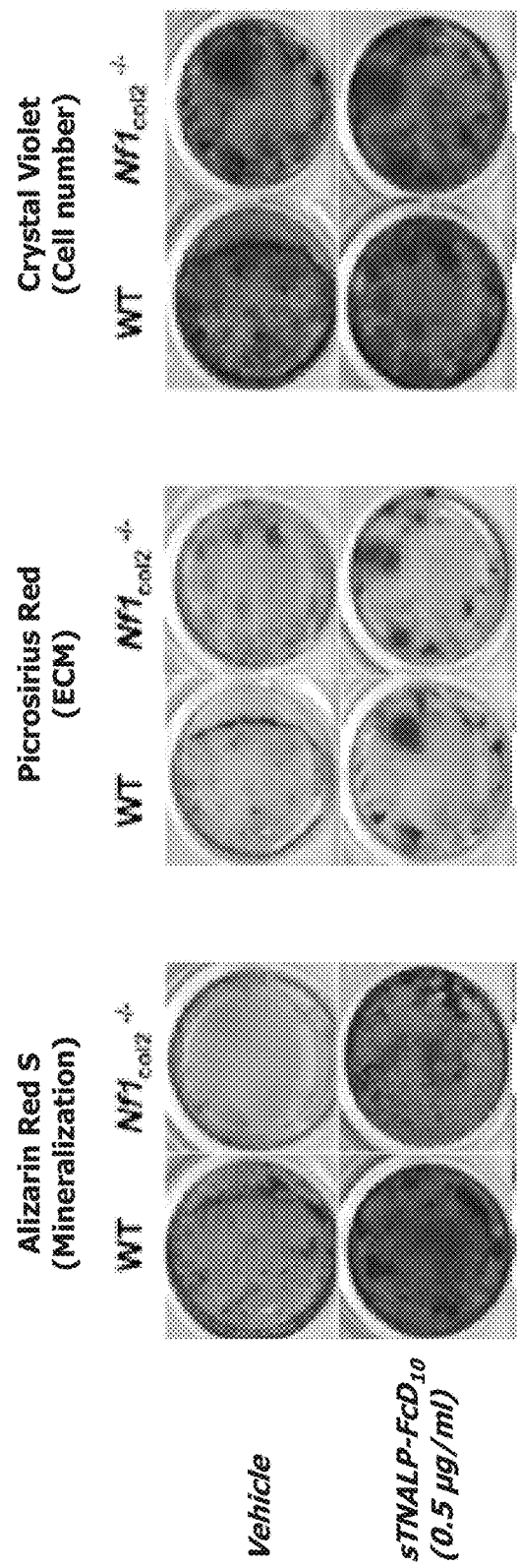
FIG. 3C shows the effect of an sALP fusion polypeptide (sTNALP-$FcD_{10}$, SEQ ID NO: 1204) in bone marrow stromal cells (BMSCs) from wild-type mice (labeled "WT") and $NF1_{col2}{}^{-/-}$ mice. BMSCs were plated in culture and differentiation was induced for 14 days using vitamin C and beta-glycerophosphate. Cells were then treated with 0.5 µg/mL of sTNALP-$FcD_{10}$ and stained with alizarin red to assess level of mineralization, with picrosirius red to demonstrate presence of extracellular matrix, or with crystal violet to stain cells.

In contrast, treatment with sTNALP-FcD$_{10}$ rescued the mineralization defect that is present in NF1$_{col2}^{-/-}$ osteoblasts (FIG. 3B). Increasing doses of sTNALP-FcD$_{10}$ provided increased calcific deposition in a dose-dependent manner (FIG. 3B, bottom, and FIG. 3C).

Figure 3D:
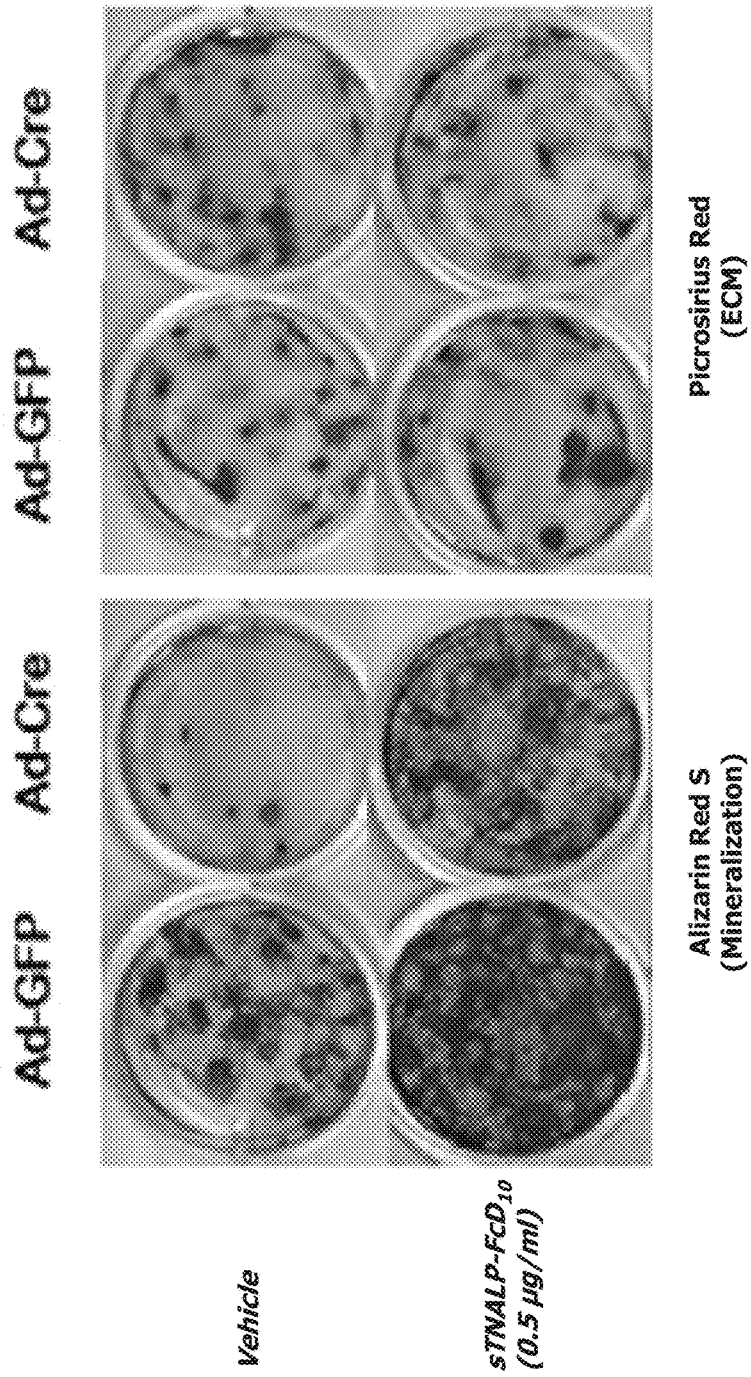
FIG. 3D shows the effect of an sALP fusion polypeptide (sTNALP-$FcD_{10}$, SEQ ID NO: 1204) in bone marrow stromal cells (BMSCs) from floxed NF1 gene mice. BMSCs were plated in culture, and differentiation was induced for 14 days using vitamin C and beta-glycerophosphate. Cells were treated for 8 days with an adenovirus coding for GFP ("Ad-GFP," as control) or an adenovirus coding for CRE recombinase ("Ad-Cre") either with vehicle or with 0.5 µg/mL of sTNALP-$FcD_{10}$. Cells were then stained with alizarin red to assess level of mineralization (first and second columns) or with picrosirius red to demonstrate presence of extracellular matrix (third and fourth columns).

Furthermore, in vitro targeted deletion of the NF1 gene in BMSCs resulted in significant reduction of mineralization, which is at least partially rescued by treatment with 0.5 μg/mL of sTNALP-FcD$_{10}$ (FIG. 3D).

Figure 3E:
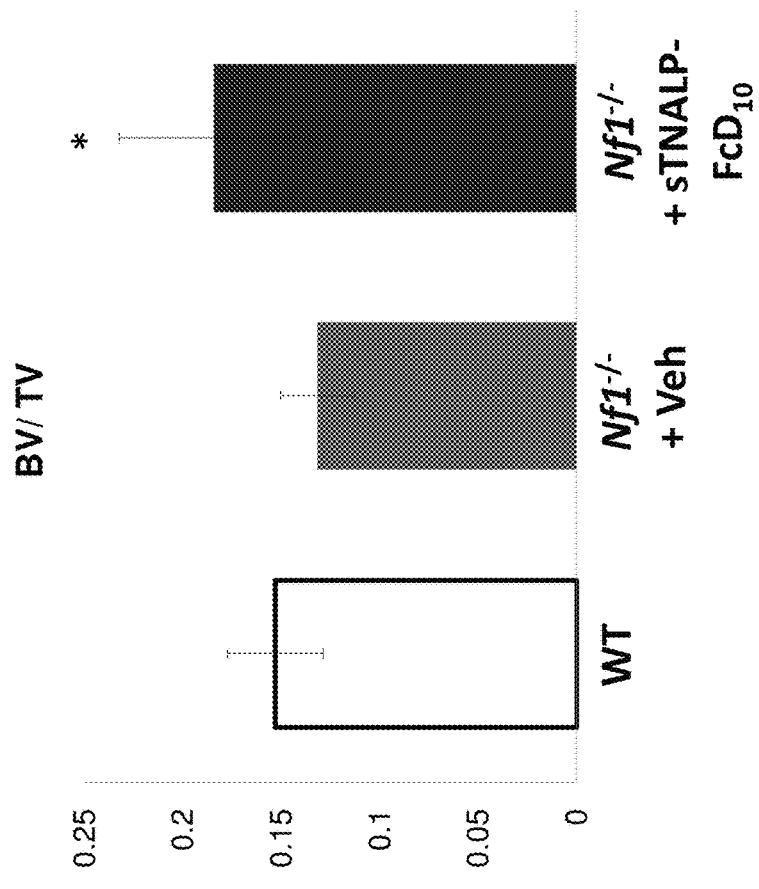
FIG. 3E shows the in vivo effect of an sALP fusion polypeptide (sTNALP-$FcD_{10}$, SEQ ID NO: 1204) in wild-type mice (labeled "WT") and $NF1_{col2}{}^{-/-}$ mice. $NF1_{col2}{}^{-/-}$ mice were treated from day 1 to day 18 with 8.2 mg/kg of sTNALP-$FcD_{10}$ and compared to untreated or WT mice. Mice were sacrificed at day 19, and vertebrae were analysed with micro-CT imaging to measure bone volume over total volume (BV/TV). Treatment of mice with sTNALP-$FcD_{10}$ increased bone mineral density deficit in $NF1_{col2}{}^{-/-}$ mice compared to vehicle (* $p<0.5$).

In vivo experiments were also conducted with sTNALP-FcD$_{10}$. NF1$_{col2}^{-/-}$ mice were treated from day 1 to day 18 with 8.2 mg/kg of sTNALP-FcD$_{10}$. Treatment of mice with sTNALP-FcD$_{10}$ increased bone mineral density deficit in NF1$_{col2}^{-/-}$ mice compared to vehicle (* p<0.5), as determined by the ratio of mineralized bone volume (BV) to total bone volume (TV) (FIG. 3E).

Accordingly, any sALP polypeptide described herein, either alone or in combination with any NP polypeptide described herein, could be particularly useful for treating neurofibromatosis or any neurocutaneous syndrome with bone manifestations.

Example 4

In Vitro and In Vivo Effects of NC2-KGANKK on NF1$_{Col2}^{-/-}$ Phenotype

Figure 4A:
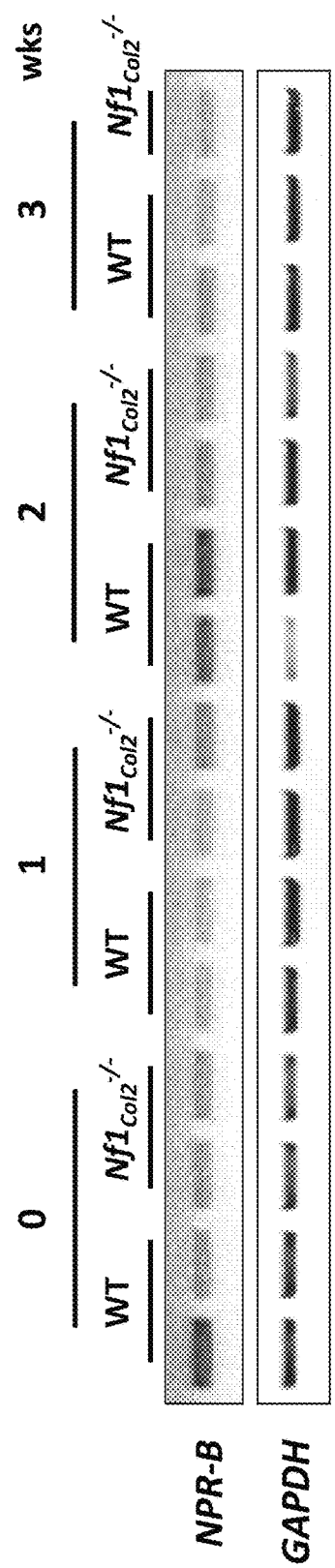
FIG. 4A shows the expression of the NPR-B gene in $NF1_{col2}{}^{-/-}$ mice. Bone marrow stromal cells were cultured for 3 weeks under osteogenic conditions (with ascorbate acetate) and lysed. RT-PCR was performed using NPR-B and housekeeping gene GAPDH primers.

To assess the effect of NP polypeptides on NF1 phenotype, expression levels of the NPR-B gene were assessed in NF1$_{col2}^{-/-}$ mice (FIG. 4A). NPR-B was expressed in BMSCs at all stages of differentiation, where lack of NF1 expression did not affect NPR-B expression.

Figure 4B:
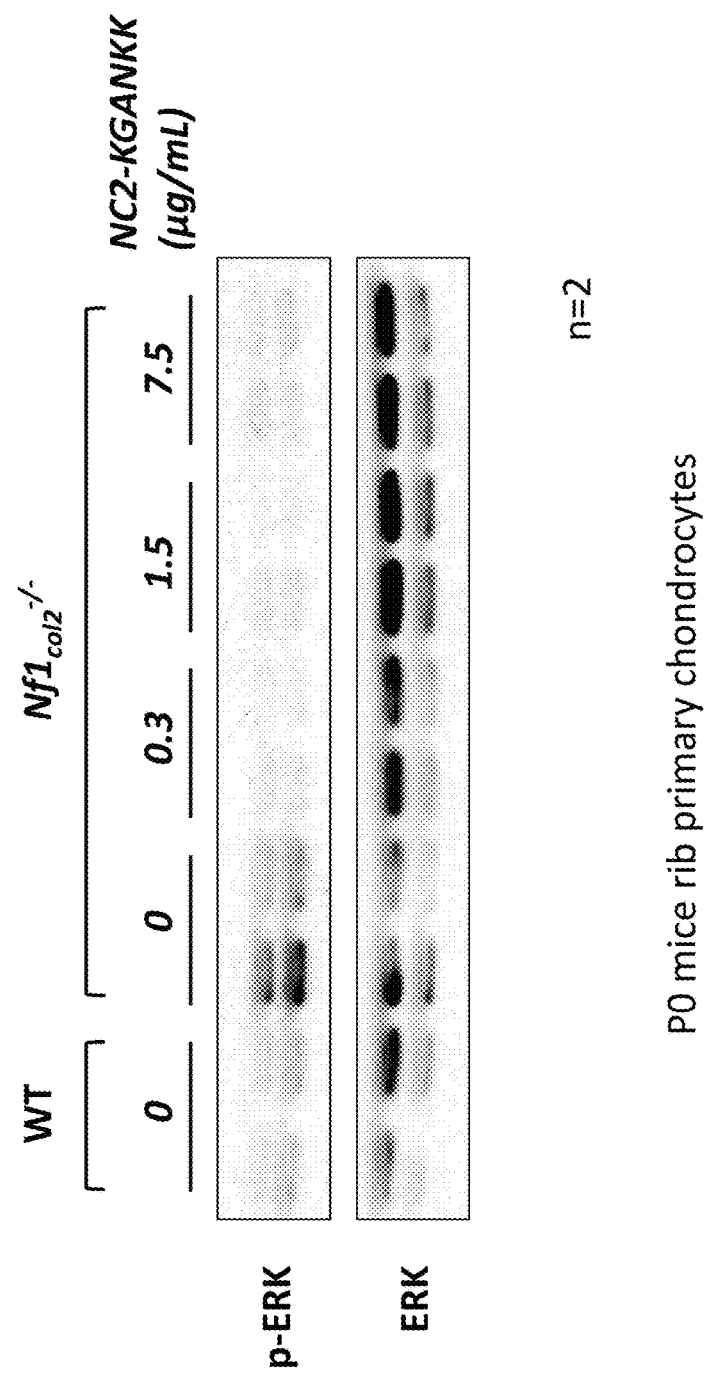
FIG. 4B shows the effect of an NP fusion polypeptide (NC2-KGANKK, SEQ ID NO: 512) in chondrocytes from wild-type mice (labeled "WT") and $NF1_{col2}{}^{-/-}$ mice. Western blot analysis provides levels of ERK and phosphorylated ERK (p-ERK) for chondrocytes from wild-type mice or from $NF1_{col2}{}^{-/-}$ mice. Primary chondrocytes extracted from ribs of newborn $NF1_{col2}{}^{-/-}$ mice or WT mice were cultured and then treated for 30 minutes with increasing concentrations of NC2-KGANKK. Cells were then lysed, and western blotting was performed on lysates using anti-ERK or anti-phospho-ERK specific antibodies.

Additional experiments were conducted in which cultures of chondrocytes from NF1$_{col2}^{-/-}$ mice were treated with the NP fusion polypeptide of NC2-KGANKK (SEQ ID NO: 512). Rib primary chondrocytes from P0 mice were obtained from wild-type mice and NF1$_{col2}^{-/-}$ mice and treated for 30 minutes with increasing concentrations of NC2-KGANKK. Without any treatment, increased levels of phosphorylated ERK (p-ERK) were observed in NF1$_{col2}^{-/-}$ chondrocytes, as compared to levels in wild-type chondrocytes (FIG. 4B). After treatment with NC2-KGANKK, decreased levels of p-ERK were observed in NF1$_{col2}^{-/-}$ chondrocytes. These results support the use of NP polypeptides, such as NC2-KGANKK, to inhibit the overactivation of one or more kinases, such as ERK.

Figure 4D:
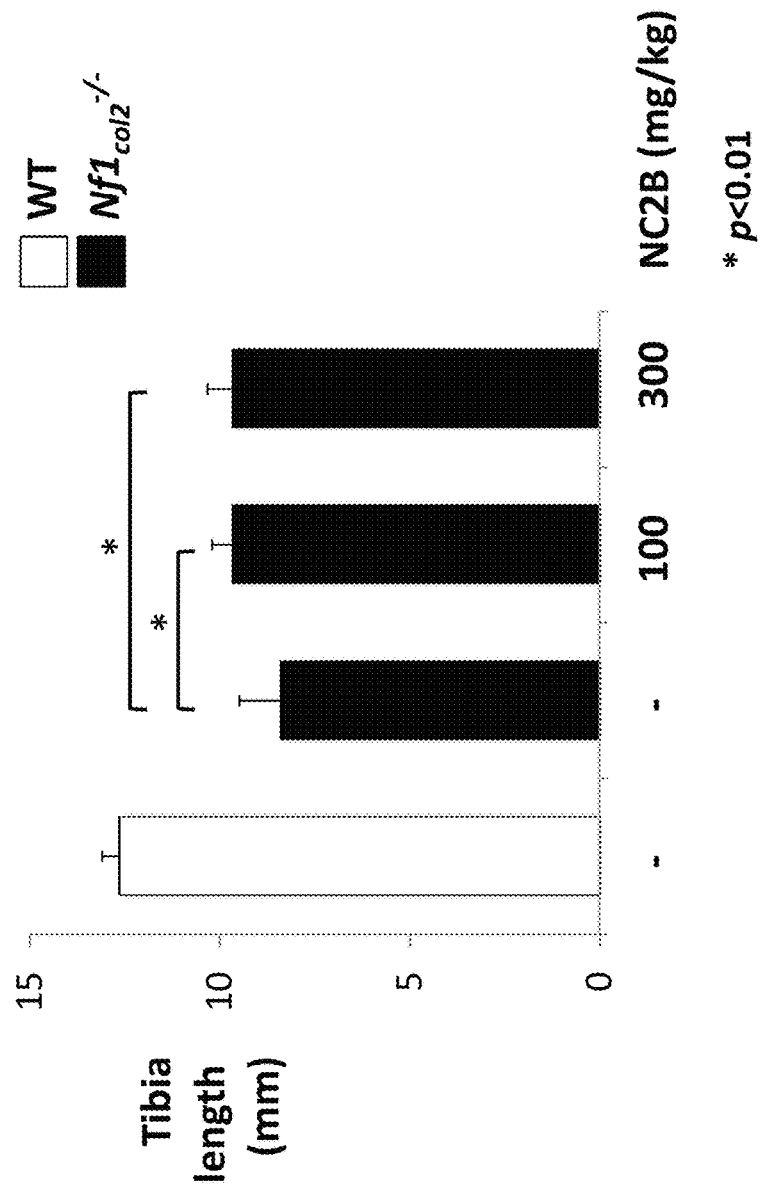
FIG. 4D shows the in vivo effect of an NP fusion polypeptide (NC2B, SEQ ID NO: 504) on tibia length in wild-type mice (labeled "WT") and $NF1_{col2}{}^{-/-}$ mice. $NF1_{col2}{}^{-/-}$ mice were treated from day 1 to day 18 with 100 or 300 mg/kg of NC2B and compared to vehicle-treated or WT mice. Mice were measured for tibia length at day 19.

In vivo experiments were also conducted. NF1$_{col2}^{-/-}$ mice were treated with NC2B (SEQ ID NO: 504). Treatment at least partially rescued the body length defect in NF1$_{col2}^{-/-}$ mice (FIG. 4C), the bone growth defect in NF1$_{col2}^{-/-}$ mice (FIG. 4D), and the proliferative and hypertrophic chondrocyte zone defects in NF1$_{col2}^{-/-}$ mice (FIG. 4E).

Accordingly, any NP polypeptide described herein, either alone or in combination with an sALP polypeptide described herein, could be particularly useful for treating disorders associated with overactivation of one or more kinases, such as neurofibromatosis or any neurocutaneous syndrome with bone manifestations.

REFERENCES

The following documents are hereby incorporated by reference.

1. Wang et al., "Mice lacking Nf1 in osteochondroprogenitor cells display skeletal dysplasia similar to patients with neurofibromatosis type I," *Hum. Mol. Genet.* 20:3910-24, 2011 (Epub 2011 Jul. 14).

2. Ali et al., "Isolation and characterization of calcifying matrix vesicles from epiphyseal cartilage," *Proc. Natl. Acad. Sci. USA* 67:1513-20, 1970.

3. Anderson et al., "Matrix vesicles in osteomalacic hypophosphatasia bone contain apatite-like mineral crystals," *Am. J. Pathol.* 151:1555-61, 1997.

4. Anderson et al., "The role of matrix vesicles in growth plate development and biomineralization," *Frontiers in Bioscience* 10:822-837, 2005.

5. Anderson et al., "Sustained osteomalacia of long bones despite major improvement in other hypophosphatasia-related mineral deficits in tissue nonspecific alkaline phosphatase/nucleotide pyrophosphatase phosphodiesterase 1 double-deficient mice," *Am. J. Pathol.* 166:1711-1720, 2005.

6. Anderson et al., "Pyrophosphate stimulation of calcium uptake into cultured embryonic bones. Fine structure of matrix vesicles and their role in calcification," *Dev. Biol.* 34:211-227, 1973.

7. Anderson et al., "Impaired Calcification Around Matrix Vesicles of Growth Plate and Bone in Alkaline Phosphatase-Deficient Mice," *Am. J. Pathol.* 164:841-847, 2004.

8. Bernard, "Ultrastructural localization of alkaline phosphatase in initial intramembranous osteogenesis," *Clin. Orthop.* 218-25, 1978.

9. DiMaura et al., "Kinetic characterization of hypophosphatasia mutations with physiological substrates," *J. Bone Miner. Res.* 17:1383-1391, 2002.

10. Farley et al., "Effects of Tunicamycin, Mannosamine, and Other Inhibitors of Glycoprotein Processing on Skeletal Alkaline Phosphatase in Human Osteoblast-Like Cells," *Calcified Tissue International* 76:63-74, 2005.

11. Fedde et al., "Alkaline phosphatase knock-out mice recapitulate the metabolic and skeletal defects of infantile hypophosphatasia," *J. Bone Miner. Res.* 14:2015-2026, 1999.

12. Greenberg et al., "A homoallelic Gly317->Asp mutation in ALPL causes the perinatal (lethal) form of hypophosphatasia in Canadian mennonites," *Genomics* 17:215-217, 1993.

13. Harmey et al., "Elevated skeletal osteopontin levels contribute to the hypophosphatasia phenotype in Akp2(-/-) mice," *J. Bone Miner. Res.* 21:1377-1386, 2006.

14. Harmey et al., "Concerted Regulation of Inorganic Pyrophosphate and Osteopontin by Akp2, Enppi, and Ank: An Integrated Model of the Pathogenesis of Mineralization Disorders," *Am. J. Pathol.* 164:1199-1209, 2004.

15. Hawrylak et al., "The solubilization of tetrameric alkaline phosphatase from human liver and its conversion into various forms by phosphatidylinositol phospholipase C or proteolysis," *J. Biol. Chem.* 263:14368-14373, 1988.

16. Henthom et al., "Different missense mutations at the tissue-nonspecific alkaline phosphatase gene locus in autosomal recessively inherited forms of mild and severe hypophosphatasia," *Proc. Natl. Acad. Sci. USA* 89:9924-9928, 1992.

17. Henthom et al., "Missense mutations of the tissue-nonspecific alkaline phosphatase gene in hypophosphatasia," *Clin. Chem.* 38:2501-2505, 1992.

18. Hessle et al., "Tissue-nonspecific alkaline phosphatase and plasma cell membrane glycoprotein-1 are central antagonistic regulators of bone mineralization," *Proc. Natl. Acad. Sci. USA* 99:9445-9449, 2002.

19. Ikezawa, "Glycosylphosphatidylinositol (GPI)-Anchored Proteins," *Biol. Pharm. Bull.* 25:409-417, 2002.

20. Jansonius et al., "Structure, evolution and action of vitamin B6-dependent enzymes," *Curr. Opin. Struct. Biol.* 8:759-769, 1998.

21. Johnson et al., "Matrix vesicle plasma cell membrane glycoprotein-1 regulates mineralization by murine osteoblastic MC3T3 cells," *J. Bone Miner. Res.* 14:883-892, 1999.

22. Mahmood et al., "Selection of the First-Time Dose in Humans: Comparison of Different Approaches Based on Interspecies Scaling of Clearance," *J. Chn. Pharmacol.* 43:692-697, 2003.

23. Meyer, "Can biological calcification occur in the presence of pyrophosphate?" *Arch. Biochem. Biophys.* 231:1-8, 1984.

24. Millan, "Mammalian Alkaline Phosphatases. From Biology to Applications in Medicine and Biotechnology," Wiley-VCH Verlag GmbH & Co., Weinheim, Germany 1-322, 2006.

25. Morris et al., "Immunolocalization of alkaline phosphatase in osteoblasts and matrix vesicles of human fetal bone," *Bone Miner.* 19:287-98, 1992.

26. Murshed et al., "Unique coexpression in osteoblasts of broadly expressed genes accounts for the spatial restriction of ECM mineralization to bone." *Genes Dev.* 19:1093-1104, 2005.

27. Nasu et al., "Aberrant interchain disulfide bridge of tissue-nonspecific alkaline phosphatase with an Arg433Cys substitution associated with severe hypophosphatasia," *FEBS Journal* 273:5612-5624, 2006.

28. Narisawa et al., "Inactivation of two mouse alkaline phosphatase genes and establishment of a model of infantile hypophosphatasia," *Developmental Dynamics* 208:432-446, 1997.

29. Narisawa et al., "Abnormal vitamin B6 metabolism in alkaline phosphatase knock-out mice causes multiple abnormalities, but not the impaired bone mineralization," *J. Pathol.* 193:125-133, 2001.

30. Nishioka et al., "Enhancement of drug delivery to bone: Characterization of human tissue-non specific alkaline phosphatase tagged with an acidic oligopeptide," *Mol. Genet. Metab.* 88:244-255, 2006.

31. Nosjean et al., "Human tissue non-specific alkaline phosphatases: Sugar-moiety-induced enzymic and antigenic modulations and genetic aspects," *Biochem. J.* 321:297-303, 1997.

32. Oda et al. "A General Method for Rapid Purification of Soluble Versions of Glycosyhosphatidylinositol-Anchored Proteins Expressed in Insect Cells: An Application for Human Tissue-Nonspecific Alkaline Phosphatase," *J. Biochem.* 126:694-699, 1999.

33. Rezende et al., "Inorganic pyrophosphate-phosphohydrolytic activity associated with rat osseous plate alkaline phosphatase," *Cell. Mol. Biol.* 44:293-302, 1998.

34. Urlaub et al., "Deletion of the Diploid Dihydrofolate-Reductase Locus from Cultured Mammalian-Cells," *Cell* 33:405-412, 1983.

35. Waymire et al., "Mice Lacking Tissue Nonspecific Alkaline-Phosphatase Die from Seizures Due to Defective Metabolism of Vitamin-B-6," *Nature Genet.* 11:45-51, 1995.

36. Weiss et al. "A missense mutation in the human liver/bone/kidney alkaline phosphatase gene causing a lethal form of hypophosphatasia," *Proc. Natl. Acad. Sci. USA* 85:7666-9, 1988.

37. Weninger et al., "Biochemical and Morphological Effects of Human Hepatic Alkaline-Phosphatase in A Neonate with Hypophosphatasia," *Acta. Paediatrica Scandinavica* 154-160, 1989.

38. Whyte, "Hypophosphatasia and the Role of Alkaline-Phosphatase in Skeletal Mineralization," *Endocrine Reviews* 15:439-461, 1994.

39. Whyte, "Alkaline Phosphatase: Placental and Tissue-nonspecific Isoenzymes hydrolyze Phosphoethanolamine, Inorganic Pyrophosphate, and Pyridoxal 5'-phosphate," *J. Clin. Invest.* 95:1440-1445, 1995.

40. Whyte, "Hypophosphatasia," in The Metabolic and Molecular Bases of Disease, edn 8th, pp 5313-5329. Eds C L Scriver, A L Beaudet, W S Sly, D Valle & B Vogelstein. New York: McGraw-Hill Book Company, 2001.

41. Whyte, "Hypophosphatasia. Nature's window on alkaline phosphatase function in man," In Principle of Bone Biology, edn Second, pp 1229-1248. Eds JP Bilezikian, L G Raisz & G A Rodan. London: Academic Press. 2002.

42. Whyte et al., "Marrow cell transplantation for infantile hypophosphatasia," *J. Bone Miner. Res.* 18:624-636, 2003.

43. Whyte et al., "Markedly Increased Circulating Pyridoxal-5'-Phosphate Levels in Hypophosphatasia-Alkaline-Phosphatase Acts in Vitamin-B6 Metabolism," *J. Clin. Invest.* 76:752-756, 1985.

44. Whyte et al., "Enzyme replacement therapy for infantile hypophosphatasia attempted by intravenous infusions of alkaline phosphatase-rich Paget plasma: results in three additional patients," *J. Pediatr.* 105:926-933, 1984.

45. Whyte et al., "Infantile hypophosphatasia: enzyme replacement therapy by intravenous infusion of alkaline phosphatase-rich plasma from patients with Paget bone disease," *J. Pediatr.* 101:379-386, 1982.

46. Zurutuza et al., "Correlations of genotype and phenotype in hypophosphatasia," *Human Molecular Genetics* 8:1039-1046, 1999.

47. Beertsen et al., "Root development in mice lacking functional tissue non-specific alkaline phosphatase gene: Inhibition of acellular cementum formation," *J. Dent. Res.* 78:1221-1229, 1999.

48. Potter et al., "Natriuretic peptides, their receptors, and cyclic guanosine monophosphate-dependent signaling functions," *Endocr. Rev.* 27:47-72, 2006.

49. Hagiwara et al., "Autocrine regulation of rat chondrocyte proliferation by natriuretic peptide C and its receptor, natriuretic peptide receptor-B," *J. Biol. Chem.* 269:10729-33, 1994.

50. Hagiwara et al., "cGMP produced in response to ANP and CNP regulates proliferation and differentiation of osteoblastic cells," *Am. J. Physiol.* 270: C1311-8, 1996.

51. Suda et al., "C-type natriuretic peptide as an autocrine/paracrine regulator of osteoblast. Evidence for possible presence of bone natriuretic peptide system," *Biochem. Biophys. Res. Commun.* 223: 1-6, 1996.

52. Yasoda et al., "Natriuretic peptide regulation of endochondral ossification. Evidence for possible roles of the C-type natriuretic peptide/guanylyl cyclase-B pathway," *J. Biol. Chem.* 273:11695-700, 1998.

53. Mericq et al., "Regulation of fetal rat bone growth by C-type natriuretic peptide and cGMP," *Pediatr. Res.* 47:189-93, 2000.

54. Daggubati et al., "Adrenomedullin, endothelin, neuropeptide Y, atrial, brain, and C-natriuretic prohormone peptides compared as early heart failure indicators," *Cardiovasc. Res.* 36: 246-55, 1997.

55. Kalra et al., "The role of C-type natriuretic peptide in cardiovascular medicine," *Eur. Heart J.* 22:997-1007, 2001.

56. Pfeifer et al., "Intestinal secretory defects and dwarfism in mice lacking cGMP-dependent protein kinase II," *Science* 274:2082-6, 1996.

57. Yasoda et al., "Overexpression of CNP in chondrocytes rescues achondroplasia through a MAPK-dependent pathway," *Nat. Med.* 10:80-6, 2004.

58. Chusho et al., "Dwarfism and early death in mice lacking C-type natriuretic peptide," *Proc. Natl. Acad. Sci. USA* 98:4016-21, 2001.

59. Yoder et al., "Reduced ability of C-type natriuretic peptide (CNP) to activate natriuretic peptide receptor B (NPR-B) causes dwarfism in lbab−/− mice," *Peptides* 29:1575-1581, 2008.

60. Bocciardi et al., "Overexpression of the C-type natriuretic peptide (CNP) is associated with overgrowth and bone anomalies in an individual with balanced t(2;7) translocation," *Hum. Mutat.* 28:724-31, 2007.

61. Tamura et al., "Critical roles of the guanylyl cyclase B receptor in endochondral ossification and development of female reproductive organs," *Proc. Natl Acad. Sci. USA* 101:17300-5, 2004.

62. Tsuji et al., "A loss-of-function mutation in natriuretic peptide receptor 2 (Npr2) gene is responsible for disproportionate dwarfism in cn/cn mouse," *J. Biol. Chem.* 280:14288-92, 2005.

63. Miyazawa et al., "Cyclic GMP-dependent protein kinase II plays a critical role in C-type natriuretic peptide-mediated endochondral ossification," *Endocrinology* 143:3604-10, 2002.

64. Teixeira et al., "Nitric oxide, C-type natriuretic peptide and cGMP as regulators of endochondral ossification," *Develop. Biol.* 319:171-8, 2008.

65. Horton et al., "Achondroplasia," *Lancet* 370:162-72, 2007.

66. Nakao et al., "The pharmacokinetics of alpha-human atrial natriuretic polypeptide in healthy subjects," *Eur. J. Clin. Pharmacol.* 31:101-3, 1986.

67. Brenner et al., "Diverse biological actions of atrial natriuretic peptide," *Physiol. Rev.* 70:665-99, 1990.

68. Farnum et al., "In vivo delivery of fluoresceinated dextrans to the murine growth plate: Imaging of three vascular routes by multiphoton microscopy," *Anat. Rec. A Discov. Mol. Cell. Evol. Biol.,* 288A:91-103, 2006.

69. Williams et al., "Solute transport in growth plate cartilage: In vitro and in vivo," *Biophys. J.* 93:1039-50, 2007.

70. Chen et al., "Gly369Cys mutation in mouse FGFR3 causes achondroplasia by affecting both chondrogenesis and osteogenesis," *J. Clin. Invest.* 104:1517-25, 1999.

71. Yasoda et al., "Systemic Administration of C-Type Natriuretic Peptide as a Novel Therapeutic Strategy for Skeletal Dysplasias," *Endocrinology* 150:3138-44, 2009.

Other Embodiments

All publications, patents, and patent applications mentioned in the above specification are hereby incorporated by reference. Various modifications and variations of the described method and system of the invention will be apparent to those skilled in the art without departing from the scope and spirit of the invention. Although the invention has been described in connection with specific embodiments, it should be understood that the invention as claimed should not be unduly limited to such specific embodiments. Indeed, various modifications of the described modes for carrying out the invention that are obvious to those skilled in the art are intended to be within the scope of the invention.

Other embodiments are in the claims.

SEQUENCE LISTING (1221 sequences)

SEQ ID NO: 1 - protein, 28 aa, Homo sapiens
SLRRSSCFGGRMDRIGAQSGLGCNSFRY

SEQ ID NO: 2 - protein, 32 aa, Homo sapiens
TAPRSLRRSSCFGGRMDRIGAQSGLGCNSFRY

SEQ ID NO: 3 - protein, 32 aa, Homo sapiens
SPKMVQGSGCFGRKMDRISSSSGLGCKVLRRH

SEQ ID NO: 4 - protein, 22 aa, Homo sapiens
GLSKGCFGLKLDRIGSMSGLGC

SEQ ID NO: 5 - protein, 38 aa, Dendroaspis angusticeps
EVKYDPCFGHKIDRINHVSNLGCPSLRDPRPNAPSTSA

SEQ ID NO: 6 - protein, 17 aa, Artificial Sequence
  Synthetic Construct
  MISC_FEATURE (4)..(6): Xaa can be any naturally occurring amino acid or any amino acid at the corresponding position in one of SEQ ID NOs: 1-5
  MISC_FEATURE (10)..(12): Xaa can be any naturally occurring amino acid or any amino acid at the corresponding position in one of SEQ ID NOs: 1-5
  MISC_FEATURE (14)..(14): Xaa can be any naturally occurring amino acid or any amino acid at the corresponding position in one of SEQ ID NOs: 1-5
CFGXXXDRIXXXSXLGC

SEQ ID NO: 7-10 - skipped (4 entries)

SEQ ID NO: 11 - protein, 53 aa, Homo sapiens
DLRVDTKSRAAWARLLQEHPNARKYKGANKKGLSKGCFGLKLDRIGSMSGLGC

SEQ ID NO: 12 - protein, 17 aa, Homo sapiens
CFGLKLDRIGSMSGLGC

SEQ ID NO: 13 - protein, 22 aa, Bos taurus
GLSKGCFGLKLDRIGSMSGLGC

SEQ ID NO: 14 - protein, 22 aa, Ovis aries
GLSKGCFGLKLDRIGSMSGLGC

SEQ ID NO: 15 - protein, 22 aa, Mus musculus
GLSKGCFGLKLDRIGSMSGLGC

SEQ ID NO: 16 - protein, 22 aa, Sus scrofa
GLSKGCFGLKLDRIGSMSGLGC

SEQ ID NO: 17 - protein, 27 aa, Unknown
  Micrurus fulvius fulvius
GLAKEALGDGCFGLKLDRIGTSSGLGC

SEQ ID NO: 18 - protein, 18 aa, Taeniopygia guttata
GCFGLKLDRIGTFSGLGC

SEQ ID NO: 19 - protein, 22 aa, Gallus gallus
GLSRSCFGVKLDRIGSMSGLGC

SEQ ID NO: 20 - protein, 20 aa, Rana catesbeiana
SRGCFGVKLDRIGAFSGLGC

SEQ ID NO: 21 - protein, 22 aa, Anguilla japonica
GWNRGCFGLKLDRIGSLSGLGC

SEQ ID NO: 22 - protein, 22 aa, Oncorhynchus mykiss
GWNRGCFGLKLDRIGSMSGLGC

SEQ ID NO: 23 - protein, 22 aa, Ornithorhynchus anatinus
GLSKGCFGLKLDRIGSTSGLGC

SEQ ID NO: 24 - protein, 19 aa, Unknown
  Trimeresurus flavoviridis
KGCFGHKLDRIGSTSGLGC

SEQ ID NO: 25 - protein, 20 aa, Unknown
  Polypterus endlicheri
SKGCFGLKLDRIGSISGLGC

SEQ ID NO: 26 - protein, 21 aa, Xenopus laevis
LSKGCFGLKLDRIGVVSGLGC

SEQ ID NO: 27 - protein, 18 aa, Oryzias latipes
GCFGMKMDRIGSISGLGC

SEQ ID NO: 28 - protein, 18 aa, Unknown
  Tetraodon nigroviridis
GCFGMKIDRIGSISGLGC

SEQ ID NO: 29 - protein, 23 aa, Pseudechis australis
SKIGDGCFGLPLDHIGSVSGLGC

SEQ ID NO: 30 - protein, 27 aa, Artificial Sequence
  Synthetic Construct
  MISC_FEATURE (1)..(10): Xaa can be any naturally occurring amino acid or any amino acid at the corresponding position in one of SEQ ID NOs: 4 and 13-29
  MISC_FEATURE (14)..(16): Xaa can be any naturally occurring amino acid or any amino acid at the corresponding position in one of SEQ ID NOs: 4 and 13-29
  MISC_FEATURE (18)..(18): Xaa can be any naturally occurring amino acid or any amino acid at the corresponding position in one of SEQ ID NOs: 4 and 13-29
  MISC_FEATURE (21)..(22): Xaa can be any naturally occurring amino acid or any amino acid at the corresponding position in one of SEQ ID NOs: 4 and 13-29
XXXXXXXXXXCFGXXXDXIGXXSGLGC

SEQ ID NO: 31 - protein, 126 aa, Oryzias latipes
MAVCSSSSLILLTVFLSVAVETRPSSDRDEEQVLKSLFGPHLTSLILAPPTSNDSTEGSSGSPEPPTPSEAPVLIHGDRGTASQILRSFLRQREKTRRWGRKPMVAGGGCFGMKMDRIGSISGLGC

SEQ ID NO: 32 - protein, 130 aa, Unknown
  Takifugu rubripes
MAASSSSFVPLVLLFLAIPVEPRPSMTRDEAQVLRALFGARLSSIISTPVNTDDIAELLPRRPGPPRSFGASPGALRGLTRGSEGGSRFLLDFLQQQSKTTRRGRSSMVGGRGCFGMKIDRIGSISGLGC

SEQ ID NO: 33 - protein, 150 aa, Acipenser transmontanus
MSISSSSSSSSSSSSCLLLISLMLLAASCQGRPDLQHRNHKSQLAGLFGAEVAALLEDAGAADGSSGEEAALSQRAPPSIRALHPRSGRLGLRDDLEAEPPAENKPRRRLLKDFMSSRKMFRGRTKKMQQGRGCFGMKLDRIGSMSGLGC

SEQ ID NO: 34 - protein, 126 aa, Mus musculus
MHLSQLIACALLLALLSLRPSEAKPGTPPKVPRTPPGEELADSQAAGGNQKKGDKTPGSGGANLKGDRSRLLRDLRVDTKSRAAWARLLHEHPNARKYKGGNKKGLSKGCFGLKLDRIGSMSGLGC

SEQ ID NO: 35 - protein, 126 aa, Mus musculus; identical to SEQ ID NO: 34

SEQ ID NO: 36 - protein, 147 aa, Unknown
  Notomys alexis
MHLSQLIACALLLALLSLRPSEAKPGTPPKVPRTPPGEELADSQAAGGNQKKGDKTPGGGGANLKGDRSRLLKGDKTPGGGGANLKGDRSRLLRDLRVDTKSRAAWARLLHEHPNARKNKGGNKKGLSKGCFGLKLDRIGSMSGLGC

SEQ ID NO: 37 - protein, 126 aa, Rattus norvegicus
MHLSQLIACALLLALLSLRPSEAKPGTPPKVPRTPPGEELAEPQAAGGNQKKGDKTPGGGGANLKGDRSRLLRDLRVDTKSRAAWARLLHEHPNARKYKGGNKKGLSKGCFGLKLDRIGSMSGLGC

SEQ ID NO: 38 - protein, 126 aa, Bos taurus
MHLSQLLACALLLALLSLRPSEAKPGAPPKVPRTPSGEEVAEPQAAGGGQKKGDKTPGGGGANLKDDRSRLLRDLRVDTKSRAAWTRLLHEHPNARKYKGGNKKGLSKGCFGLKLDRIGSMSGLGC

SEQ ID NO: 39 - protein, 126 aa, Ovis aries
MHLSQLLACALLLSLLSLRPSEAKPGAPPKVPRTPPGEEVAEPQAAGGGQKKGDKTPGGGGANLKDDRSRLLRDLRVDTKSRAAWTRLLHEHPNARKYKGGNKKGLSKGCFGLKLDRIGSMSGLGC

SEQ ID NO: 40 - protein, 126 aa, Sus scrofa
MHLSQLLACALLLTLLSLRPSEAKPGAPPKVPRTPPGEEVAEPQAAGGGQKKGDKTPGGGGANLKGDRSRLLRDLRVDTKSRAAWARLLHEHPNARKYKGGNKKGLSKGCFGLKLDRIGSMSGLGC

SEQ ID NO: 41 - protein, 126 aa, Homo sapiens
MHLSQLLACALLLTLLSLRPSEAKPGAPPKVPRTPPAEELAEPQAAGGGQKKGDKAPGGGGANLKGDRSRLLRDLRVDTKSRAAWARLLQEHPNARKYKGANKKGLSKGCFGLKLDRIGSMSGLGC

SEQ ID NO: 42 - protein, 121 aa, Ornithorhynchus anatinus
MHLSHLLAWALLLTLLSLRAEAKPPSPQPQVPRSPGDEASEAVAANGGGKKGDKEPKGDRPRLLRELRLDTRSRGSRGVWTRLLHDHPNPRKYKPANKKGLSKGCFGLKLDRIGSTSGLGC

SEQ ID NO: 43 - protein, 33 aa, Cavia porcellus
NARKYKGGNKKGLSKGCFGLKLDRIGSMSGLGC

SEQ ID NO: 44 - protein, 121 aa, Oryzias latipes
MNLSYLVACGLLVTFLSDKMDAQPLTPAQQKSLRSLLGEELAEFLESGENENRLDDVRSRMRLLRDLRVDTRARGMWARLLNDQPASRRHKSGSKKGGSTSRSGCFGHKMDRIGTISGMGC

SEQ ID NO: 45 - protein, 120 aa, Unknown
  Takifugu rubripes
MNLSYLVACGLMITLLSVRMGAKPLSQAQQKSFRSLLGEELAEFLESEEKERRLDAVRSRLRLLRDLRMDTRARGVWARLLNDQPVPRRHKTGIKKGGSSRSGCFGHKMDRIGTISGMGC

SEQ ID NO: 46 - protein, 121 aa, Esox lucius
MNISYLVACGLMITLLSVRSGAKPLTAAQQKSLRNLLGEELSEFLASGERERRLDTVRSRVRLLRDLRMDTRAKGMWARLLNDQPNARRHKQNSKKGTVPRSGCFGQKLDRIGTLSGMGCN

SEQ ID NO: 47 - protein, 120 aa, Anguilla japonica
MNVSQLMVCGLLMALFSFSTEAKSLIPAQEKSLRNLLGEELSEYLASGERERNLESARSRLLRDLRLNTRARGMWSRIMNDQPASRKQKTGVKKGASTPARGGCFGHKLDRISTLSGMGC

SEQ ID NO: 48 - protein, 118 aa, Unknown
  Actinopterygii
MNISHLVACGLLVALLTVTMEAKPLTQSQQKSLRNLLGEELSAYLTSDEQESGSENLRSRARLLRDLRLDIRAKAAWARLLNDHPNPRKSKGINKKGLSKGCFGLKLDRIGSMSGLGC

SEQ ID NO: 49 - protein, 118 aa, Rana catesbeiana
MHFCHIVGWGLVLAVLYLRTEAKPVAQAHQKSLRALLGEELAEYLVSGERGERSIDPKTRARLLRDIRADTRSRAAWTRLLNEHPNSRKIKGINKKGTSKGCFGLKLDRIGAMSGLGC

SEQ ID NO: 50 - protein, 193 aa, Trimeresurus flavoviridis
MFVSRLAASGLLLLALLALSLDGKPVHQSKPGRSPPISPLSAQQWMPEGRPPHPIPPLSVQQWSQGRPRSEVPPVVVQPHESPAGGTTAFREELSPGPEAASGPAAPHRLPKSKGASATSAASRPMRDLRTDGKQERQKWGRMVQPDHHAAPGGGGGGGGGARRMKGLAKKAMGKGCFGHKLDRIGSTSGLGC

SEQ ID NO: 51 - protein, 210 aa, Trimeresurus gramineus
MFVSRLAASGLLLLALLALSLDGKPVQEKPGRSPPISPLLVPPPPPPPHWPPPHHIPPLSVQKFPPGWKPTHPHHIPPLEVQQWSQGGPRSELVQPHESPAGGTTAFREELSLGPEAASGPAAPQRLPKRKGASATSAASRSMRDLRADGKQARQKWGRMVQPDHHAAPGGGGGGGGGARRLKGLAKKAVGKGCFGLPLDRIGSMSGMGC

SEQ ID NO: 52 - protein, 256 aa, Bothrops jararaca
MVLSRLAASGLLLLALLALSVDGKPVQQWAQSWPGPNIPPLKVQQWAQGGWPRPGPEIPPLTVQQWAQNWPHPQIPPLTVQQWAQGRAPGPPIPPLTVQQWAQGRAPHPPIPPAPLQKWAPLQKWAPLLQPHESPASGTTALREELSLGPEAASGVPSAGAEVGRSGSKAPAAPHRLSKSKGAAATRPMRDLRPDGKQARQNWGRMAHHDHHAAAGGGGGGGGGARRLKGLAKKGAAKGCFGLKLDRIGTMSGLGC

SEQ ID NO: 53 - protein, 265 aa, Bothrops jararaca
MVLSRLAASGLLLLALLALSVDGKPVQQWAQGGWPRPGPEIPPLKVQQWAQGGWPRPGPEIPPLTVQQWAQNWPHPQIPPLTVQQWAQWGRPPGPPIPPLTVQQWAQARPPHPPIPPAPLQKWAPVQKWAPLLQPHESPASGTTALREELSLGPEAASGVPSAGAEVGRSGSKAPAAPHRLSKSKGAAATSAASRPMRDLRPDGKQARQNWGRMVHHDHHAAVGGGGGGGGGGARRLKGLAKKGAAKGCFGLKVDRIGTMSGLGC

SEQ ID NO: 54 - protein, 265 aa, Bothrops insularis
MVLSRLAASGLLLLALLALSVDGKPVQQWAQGGWPRPGPEIPPLKVQQWAQGGWPRPGPEIPPLTVQQWAQNWPHPQIPPLTVQQWAQLGPPPRPQIPPLEVQQWAQGRAPHPPIPPAPLQKWAPVQKWAPLLQPHESPASGTTALREELSLGPEAASGVPSAGAEVGRSGSKAPAAPHRLSKSKGAAATSAASRPMRDLRPDGKQARQNWGRMVHHDHHAAVGGGGGGGGGGARRLKGLAKKGAAKGCFGLKLDRIGTMSGLGC

SEQ ID NO: 55 - protein, 181 aa, Unknown
  Crotalus durissus terrificus
MFVSRLAASGLLLLALLAVSLDGKPLQQWSQRWPHLEIPPLVVQNWKSPTQLQARESPAGGTTALREELSLGPEAALDTPPAGPDGGPRGSKAAAAAPQRLSKSKGASATSAASRDLRTDGKQARQNWGRLVSPDHHSAAGGGCGGGGGARRLKGLAKKRAGNGCFGLKLDRIGSMSGLGC

SEQ ID NO: 56 - protein, 181 aa, Unknown
  Crotalus durissus collilineatus
MFVSRLAASGLLLLALLAVSLDGKPLQQWSQRWPHLEIPPLVVQNWKSPTQLQARESPAGGTTALREELSLGPEAALDTPPAGPDGGPRGSKAAAAAPQRLSKSKGASATSAASRDLRTDGKQARQNWGRLVSPDHHSAAGGGGGGGGGARRLKGLAKKRAGNGCFGLKLDRIGSMSGLGC

SEQ ID NO: 57 - protein, 201 aa, Unknown
  Sistrurus catenatus edwardsii
MFVSRLAASGLLLLALLAVSLDGKPVQQWSQNWPGPKVPPLVVQQWSQNWPHPQIPPLVVQNWKSPTQLQPRESPAGGTTALREELSLGPDAALDTPPAGPDVGPRGSKAAAAPQRLSKSKGASATSTASRPMRDLRTDGKQARQNWGRMLNPDHHSAPGGGGGGGGGGARRLKGLAKKRAGSGCFGLKLDRIGSMSGLGC

SEQ ID NO: 58 - protein, 239 aa, Unknown
  Lachesis muta muta
MFVSRLAASGLLLLALLAVSLDGKPVQQWSHKGWPPRPQIPPLVVQQWSQKPWPPGHHIPPVVVQEWPPGHHIPPLVVQQWSQKKWPPGHHIPPLVVQKWDPPPISPPLLKPHESPAGGTTALREELSLGPEAALDTPPAGPDVGPRGSKAPAAPHRLPKSKGASATSAASRPMRDLRTDGKQARQNWGRMMNPDHHAVGGGGGGGGARRLKGLAKKRVGDGCFGLKLDRIGSMSGLGC

SEQ ID NO: 59 - protein, 263 aa, Unknown
  Agkistrodon halys blomhoffi
MFVSRLAASGLLLLALMALSLDGKPVQQWSQGRPPGPPIPRLVVQQWSQGLPPGPPIPRLVVQQWSQGLPPGPPIPPLVVQQWSQGLPPRPKIPPLVVQQWSQGLPPRPKIPPLVVQKWDPPPVSPPLLLQPHESPAGGTTALREELSLGPEAASGPAAAGADGGRSGSKAPAALHRLSKSKGASATSASASRPMRDLRTDGKQARQNWARMVNPDHHAVGGCCCGGGGGGARRLKGLVKKGVAKGCFGLKLDRIGTMSGLGC

SEQ ID NO: 60 - protein, 164 aa, Unknown
  Philodryas olfersii
MVASRLAAGGLLLLALLALALDGKPAPPQPLRKAPAGGTTAWRRELTEQPEGASRPAAGGGGGGGRSGSKAANAAPTAPKSKGGAAAAAAAAARLMRDLRPDSKQARAAWGRMVHPEHHAGGGGGGGGGGGASRRLKGVAKKGLGKGCFGLKLDRIGSMSGLGC

SEQ ID NO: 61 - protein, 161 aa, Unknown
  Rhabdophis tigrinus tigrinus
MFASRLAALGLLLLALVLDGKPAPPPQPLRKAPAGGTTALQRQLTEQQQQQQQAEGSSGPAAGGGGGRSGSKTANAAPTAPKSKGAAASAASRLLRDLRPDGKQSRAAWGRMVHPEHHAGGGGGGGGGGSRRLKGLPKKGLGSGCFGLKLDRIGSMSGLGC

SEQ ID NO: 62 - protein, 221 aa, Bothrops jararacussu
HEKPSRSGAKSAAVGAKLAASSDSAADECSSGRKGEPPGPPIPPLTVQQWAQARPPHPPIPPAPLQKWAPVQKWAPVQKWAPLLQPHESPAGGTTALREELSLGPEAASGVPSAGAEGRAQRLEGARCTPSAVEEQRGGGDLGGVAADAGLAPRRQAGAAELGPDGAPRPPRPPRSGRRAAAAAAAERGARRLKGLAKKGAAKGCFGLKLDRIGTMSGLGC

SEQ ID NO: 63 - protein, 116 aa, Unknown
  Petromyzontidae
SGSEPWEGGFLPRVSSSSSSSSGEVEPLAEVTATGGVSGGVSGGVLGGTPWVGPRGHQRPSRGLAEGGSQVSGGVWQRLFNDFVSNQRRFRGRTKKGKGCFGVKLDRIGSMSGLGC

SEQ ID NO: 64 - protein, 148 aa, Lampetra japonica
MKLQLLMMVVVVGSWTFLGVGAKPLTSYELYDDAGSEPWEGGFLPRISSSSSSSAERLADATVTRHGGGGGGGGDDGTSWELPQGPPGPPRSSRGLAEGGSQVSGGVWQRLFNDFVSNQRRFRGRTKKGKGCFGVKLDRIGSMSGLGC

SEQ ID NO: 65 - protein, 133 aa, Unknown
  Petromyzontidae
MRRQVLVMVVMVVVMVVMSGKSVTAKPVASYELLDDTNSEPWEGGSLLPSLPSQGEGDSHPLSAEGGPWERGSGPQRSSRGIGGGSQVSGEVWQRLFNDFVSNQRRFRGRTKKGKGCFGVKLDRIGSMSGLGC

SEQ ID NO: 66 - protein, 22 aa, Gallus gallus
GLSRSCFGVKLDRIGSMSGLGC

SEQ ID NO: 67 - protein, 130 aa, Gallus gallus
MKLLFCPGFFLLLIVSQKQAMAKPISSLQSLSMLLDEELQHPLVSEERDREQDGSIPVGAFDQEDAEFQWTRNTRDQPASTSTADSDVQRILSDLLGLPQRYQNRSKKGLSRSCFGVKLDRIGSMSGLGC

SEQ ID NO: 68 - protein, 129 aa, Rana catesbeiana
MSYKRGTCLGFIMLLMVSHHHTKGKPLSSLQNLSRLLEDNFERSFGSDEADQQLVPTDSLDQLDPELQWNKNRLEQGDSPHVNEMTLQQLLNDPVGTSRRYRQRNKKGYSRGCFGVKLDRIGAFSGLGC

SEQ ID NO: 69 - protein, 136 aa, Triakis scyllium
MSGQTSFYCGLLLVLLIQAQARPRSDDSLQTLSRLLEDEYGHYLPSDELNNEAQEMSPAASLPEFNADQSDLELPWDRESREIGGRPFRQEAVLARLLKDLSNNPLRFRGRSKKGPSRGCFGVKLDRIGAMSGLGC

SEQ ID NO: 70 - protein, 115 aa, Scyliorhinus canicula
RPRSDDSLQTLSRLLEDEYGHYLPSDELNNEAEEMSPAASLPELNADQSDLELPWERESREIGGRPFRQEAVLARLLKDLSNNPLRFRGRSKKGPSRGCFGVKLDRIGAMSGLGC

SEQ ID NO: 71 - protein, 135 aa, Squalus acanthias
MSGHTSFYCGLLLLLLIQVQARPRADDSLQVLSRLLEDEYGHFNSEELNNEAQEISPAASLPDLNTDQSDLELPWDRESREIGGRSFRQEALLARLLQDLSNNPLRFKGRSKKGPSRSCFGLKLDRIGAMSGLGC

SEQ ID NO: 72 - protein, 131 aa, Unknown
  Chondrichthyes
MSGNTNFYCGLVLLLLLQVQGRPRSDDSLQALTRLLEDEYGQYFTTEDLNNEAPEIPPAASLPDLNTDQSDLDLSWDRESREIASRPILARILKDLSNNPLRFRGRSKKGPSRGCFGVKLDRIGAMSGLGC

SEQ ID NO: 73 - protein, 131 aa, Unknown; identical to SEQ ID NO: 72
  Chondrichthyes

SEQ ID NO: 74 - protein, 131 aa, Unknown
  Chondrichthyes
MSGNTNFYCGLVLLLLLQVQGRPRSDDSLQALTRLLEDEYGQYFTSEDLNNEAPEIPPAASLPDLNTDQPDFDLSWDRESREIASRPILARILKDLSNNPLRFRGRSKKGPSRGCFGVKLDRIGAMSGLGC

SEQ ID NO: 75 - protein, 131 aa, Dasyatis akajei
MSGNTNFYCGLVLLLLLQVQGRPRSDDSLQALTRLLEDEYGQYFTSEDLNNEAPEMSPAASLPDLNTEQSETDLPWDRESREIASRPILARILKDLNNIPLRFRGRSKKGPSRGCFGVKLDRIGAMSGLGC

SEQ ID NO: 76 - protein, 139 aa, Callorhynchus milii
MNAHVSFPCGLMLLLLIQVQVQARPRTGVDSLQILSRLLEDEYGPYLSSEDSDMEAEEASRAGTLRDLNLDQADMDLLWDRDARDIGGRSFQHDGLLLRLLKDLTISPLRFNGRSKKGPSRGCFGVKLDRIGAMSGLGC

SEQ ID NO: 77 - protein, 112 aa, Oryzias latipes
MSLRAFMLCVCLLLQSVGARPASELQNLERLLQDQLSSTEHPEEDRLDRTREEPQLGGSSSREAADESALTRLFADLLRTSKRSWGRYKKGGMRSCFGVRLERIGSFSGLGC

SEQ ID NO: 78 - protein, 112 aa, Oryzias latipes; identical to SEQ ID NO: 77

SEQ ID NO: 79 - protein, 158 aa, Unknown
  Takifugu rubripes
MSLNLPGYALFFILLVASSGAKPAPDLQILEPPLSSLEEQEEMQEEVQEKVQEQQEEVQEKVQEQQEEVQEQQEEVQEQQEEQQEEVQERGRGTGDVLLRAQLDSSTWALQKDDVLMRLFKDLLRTSKRSRSRYKKGGLRSCFGVRLARIGSFSGLGC

SEQ ID NO: 80 - protein, 128 aa, Salmo salar
MKMISNIQFFCLTALVLLNLVGANPMSNLQSLKQLLEEESHVPYYASDEMGVDGKDLNTENIAEEVPPWDSEDARNSALTGKEDVIARLLNDIMTTPKRSWSRFKKGGLRSCFGVRLERIGSFSGLGC

SEQ ID NO: 81 - protein, 126 aa, Esox lucius
MISNIQFCCLSVLVLLNLVGAKPVSNLQSLKEFLEESNVPYYGSEESEVDDKDLNTEKEAFTGEVVQPWLTEDRSALTGKENAVARLLSDIMTTPKRSWGRFKKGGMRSCFGVRLERIGSFSGLGC

SEQ ID NO: 82 - protein, 128 aa, Anguilla japonica
MISNITIYCISSLLFLNLVGGKPVSSLQSLKELLEEESNAPYLDSEEAEVQGKEMNAENAAFTKASLHSWDPNSRDAALSSNENALVRLLNDILSSSKRSWSRFKKGGLRSCFGVRLERIGSFSGLGC

SEQ ID NO: 83 - protein, 128 aa, Danio rerio
MIANISVFCVSSLLLLNLVGAKPVSSLQSLKQLLDEEVNKPFEESQESVMEQKDATAEKSALDERAEQLWESDARNSALAGKYGMFERLLGDLLSTSKRSWSRFKKGDLRSCFGVRLERIGSFSGLGC

SEQ ID NO: 84 - protein, 130 aa, Unknown
  Actinopterygii
MVSRLTVYCALFIIVLSQVSAKPVSSLQSFAQLLEDESNHPYVDSDDDTRGGLDVSAEIATDDSEADIPWNHNFRDLQHRQAAHSSRMLKLLKDILTSSGRSWDREKKSGLRSCFGVRLDRIGSMSGLGC

SEQ ID NO: 85 - protein, 131 aa, Oncorhynchus mykiss
MLYPALLCAALLLIAPLGHTEGRTLYPSPDAIQFVEQFLDRYNDLTLDDLENLVSSQPEEPSSAFTSGVKIAEYPKWADIPAQGDSTWLRLLKGTLANQKRAVTDRSRRGWNRGCFGLKLDRIGSMSGLGC

SEQ ID NO: 86 - protein, 131 aa, Oncorhynchus mykiss
MLYPALLCAALLLIAPLGHTEGRTLHPSPDAIQFVEQFLDRYNDLTLDDLENLVSSQPEEPSSAFTSGVKVAEYPKWADIPAQGDSTWLRLLKGTLANQKRAVMDRSRRGWNRGCFGLKLDRIGSMSGLGC

SEQ ID NO: 87 - protein, 132 aa, Osmerus mordax
MLCPVLLCATLVLLPPLELSEGRALHPSPEGLQFVEQFLERCTDLLNLDDLENAGSNQPEEPSDYANGVKVAEYPKWADLPAAQEDSAWLRLLKAALANQKRAEPDRSRRAWNRGCFGLKLDRIGSMSGLGC

SEQ ID NO: 88 - protein, 131 aa, Unknown
  Oreochromis mossambicus
MLCPVLLCAALLLLTPLEITEARALHPSPDAVQFVEQFLERYNDLLTLDDLENMLNSQAEEQSTLSSGSKAVEYPKWADAQTQPETPWLRLLKGALANQKRAEPDRSRRGWNRGCFGLKLDRIGSMSGLGC

SEQ ID NO: 89 - protein, 131 aa, Unknown
  Anoplopoma fimbria
MLCPVLLCATLLLLTPLEITEARALHPPPDAVQFMEQFLERYNDLLTLDDLENLLNSQPEEQSTFSSGVKAAEYPKWADAQTQAETPWLRLLKGAVANQKRAEPDRSRRGWNRGCFGLKLDRIGSMSGLGC

SEQ ID NO: 90 - protein, 131 aa, Oryzias latipes
MLCPVLLCATLLLLTPFEVTEARALHPSADAVQFVEQFLDRYNDLLTLDDLENLLNTQPEEQSTLSSGVKTAEYPKWADLQTQPETPWFRLLKGALTNQKRAEPDRSRRGWNRGCFGLKLDRIGSMSGLGC

SEQ ID NO: 91 - protein, 126 aa, Unknown
  Takifugu rubripes
MLCPALLCAALLLLTPVEITDARALQQPSDAAQFMEQFLESYNDLLTLDDLENMLNSHPEDQSNLSSSKADEYPKWAEADTPWLRLLRGALANQKRAEPDRSRRGWNRGCFGLKLDRIGSMSGLGC

SEQ ID NO: 92 - protein, 131 aa, Anguilla japonica
MMCKALVFAVLLLAVPLERADSRALRTPVDAIQFVEQFLEHYNDLLNIDDLENQTGDQLESPQPLSSGLKVAEYPKWVDVPSQNDNTWFRLLRGALANRKRALPDRAKRGWNRGCFGLKLDRIGSLSGLGC

SEQ ID NO: 93 - protein, 140 aa, Unknown
  Actinopterygii
MMGSCSAPLLTGHRILCLFLLMASSLSPIHSRAFRSPPLQFLSTLLEKEYGNLQSGPVNIHNVSSEQYEDPQPWADVSSVSKEQIWGDEPPANENALYLLLRRAAANRTWISADRVKKAWSKGCFGLKLDRIGSISGLGC

SEQ ID NO: 94 - protein, 123 aa, Gallus gallus
MLGLPAWPCSLFLLLVLLSASVQAMSSSGQRLQVLLSQLLPSDSESMPAEEDMKEGSSSEPQLLSPPLPLLPSRARAAHPLLWRKALASRKRALSGDWAWKAVPRGCFGLKMDRIGAFSGLGC

SEQ ID NO: 95 - protein, 17 aa, Artificial Sequence
  Synthetic Construct
  MISC_FEATURE (4)..(7): Xaa can be any naturally occurring amino acid or any amino acid at the corresponding position in one of SEQ ID NOs: 31-94
  MISC_FEATURE (10)..(12): Xaa can be any naturally occurring amino acid or any amino acid at the corresponding position in one of SEQ ID NOs: 31-94
  MISC_FEATURE (15)..(15): Xaa can be any naturally occurring amino acid or any amino acid at the corresponding position in one of SEQ ID NOs: 31-94
CFGXXXXRIXXXSGXGC

SEQ ID NO: 96 - protein, 28 aa, Rattus norvegicus
SLRRSSCFGGRIDRIGAQSGLGCNSFRY

SEQ ID NO: 97 - protein, 45 aa, Rattus norvegicus
SQDSAFRIQERLRNSKMAHSSSCFGQKIDRIGAVSRLGCDGLRLF

SEQ ID NO: 98 - protein, 32 aa, Sus scrofa
SPKTMRDSGCFGRRLDRIGSLSGLGCNVLRRY

SEQ ID NO: 99 - protein, 39 aa, Artificial Sequence
  Synthetic Construct
SDSKIGNGCFGFPLDRIGSVSGLGCNRIMQNPPKKFSGE

SEQ ID NO: 100 - protein, 37 aa, Artificial Sequence
  Synthetic Construct
GLSKGCFGLKLDRIGSMSGLGCPSLRDPRPNAPSTSA

SEQ ID NO: 101 - protein, 37 aa, Artificial Sequence
  Synthetic Construct
GLSKGCFGLKLDRIGSMSGLGCNSLRDPRPNAPSTSA

SEQ ID NO: 102 - protein, 37 aa, Artificial Sequence
  Synthetic Construct
GLSKGCFGLKLDRIGSMSGLGCGSLRDPRPNAPSTSA

SEQ ID NO: 103 - protein, 37 aa, Artificial Sequence
  Synthetic Construct
GLSKGCFGLKLDRIGSMSGLGCHSLRDPRPNAPSTSA

SEQ ID NO: 104 - protein, 37 aa, Artificial Sequence
  Synthetic Construct
GLSKGCFGLKLDRIGSMSGLGCKSLRDPRPNAPSTSA

SEQ ID NO: 105 - protein, 37 aa, Artificial Sequence
  Synthetic Construct
  MISC_FEATURE (23)..(23): Xaa is hydroxyproline
GLSKGCFGLKLDRIGSMSGLGCXSLRDPRPNAPSTSA

SEQ ID NO: 106 - protein, 37 aa, Artificial Sequence
  Synthetic Construct
GLSKGCFGLKLDRIGSMSGLGCPSSRDPRPNAPSTSA

SEQ ID NO: 107 - protein, 37 aa, Artificial Sequence
  Synthetic Construct
GLSKGCFGLKLDRIGSMSGLGCPSLADPRPNAPSTSA

SEQ ID NO: 108 - protein, 37 aa, Artificial Sequence
  Synthetic Construct
GLSKGCFGLKLDRIGSMSGLGCPSLRAPRPNAPSTSA

SEQ ID NO: 109 - protein, 37 aa, Artificial Sequence
  Synthetic Construct
GLSKGCFGLKLDRIGSMSGLGCPSSADPRPNAPSTSA

SEQ ID NO: 110 - protein, 37 aa, Artificial Sequence
  Synthetic Construct
GLSKGCFGLKLDRIGSMSGLGCPSLAAPRPNAPSTSA

SEQ ID NO: 111 - protein, 37 aa, Artificial Sequence
  Synthetic Construct
GLSKGCFGLKLDRIGSMSGLGCPSSRAPRPNAPSTSA

SEQ ID NO: 112 - protein, 37 aa, Artificial Sequence
  Synthetic Construct
GLSKGCFGLKLDRIGSASGLGCPSSRAPRPNAPSTSA

SEQ ID NO: 113 - protein, 37 aa, Artificial Sequence
  Synthetic Construct
GLSKGCFGLKLDRIGSMSGLGCPSSAAPRPNAPSTSA

SEQ ID NO: 114 - protein, 37 aa, Artificial Sequence
  Synthetic Construct
GLSKGCFGLKLDRIGSASGLGCPSSAAPRPNAPSTSA

SEQ ID NO: 115 - protein, 37 aa, Artificial Sequence
  Synthetic Construct
GLSKGCFGLKLDRIGSMSGLGCPSSAARRPNAPSTSA

SEQ ID NO: 116 - protein, 37 aa, Artificial Sequence
  Synthetic Construct
GLSKGCFGLKLDRIGSMSGLGCPSSAAPSPNAPSTSA

SEQ ID NO: 117 - protein, 15 aa, Artificial Sequence
  Synthetic Construct
PSLRDPRPNAPSTSA

SEQ ID NO: 118 - protein, 15 aa, Artificial Sequence
  Synthetic Construct
  MISC_FEATURE (1)..(1): Xaa can be any naturally occurring amino acid or any amino acid at the corresponding position in one of SEQ ID NOs: 100-116
  MISC_FEATURE (3)..(7): Xaa can be any naturally occurring amino acid or any amino acid at the corresponding position in one of SEQ ID NOs: 100-116
XSXXXXXPNAPSTSA

SEQ ID NO: 119 - protein, 22 aa, Artificial Sequence
  Synthetic Construct
GLSKGCFGLKLDRIGSFSGLGC

SEQ ID NO: 120 - protein, 22 aa, Artificial Sequence
  Synthetic Construct
GLSKGCFGLKLDRIGSLSGLGC

SEQ ID NO: 121 - protein, 22 aa, Artificial Sequence
  Synthetic Construct
GLSKGCFGLKLDRIGSISGLGC

SEQ ID NO: 122 - protein, 22 aa, Artificial Sequence
  Synthetic Construct
GLSKGCFGLKLDRIGSTSGLGC

SEQ ID NO: 123 - protein, 22 aa, Artificial Sequence
  Synthetic Construct
GLSKGCFGLKLDRIGSVSGLGC

SEQ ID NO: 124 - protein, 22 aa, Artificial Sequence
  Synthetic Construct
GLSKGCFGLKLDRIGSASGLGC

SEQ ID NO: 125 - protein, 22 aa, Artificial Sequence
  Synthetic Construct
GLSKGCFGLKLDRIGSSSGLGC

SEQ ID NO: 126 - protein, 22 aa, Artificial Sequence
  Synthetic Construct
  MISC_FEATURE (17)..(17): Xaa can be any naturally occurring amino acid or any amino acid at the corresponding position in one of SEQ ID NOs: 119-125
GLSKGCFGLKLDRIGSXSGLGC

SEQ ID NO: 127 - protein, 37 aa, Artificial Sequence
  Synthetic Construct
QEHPNARKYKGANKKGLSKGCFGLKLDRIGSMSGLGC

SEQ ID NO: 128 - protein, 45 aa, Artificial Sequence
  Synthetic Construct
EEEEEEPGQEHPNARKYKGANKKGLSKGCFGLKLDRIGSMSGLGC

SEQ ID NO: 129 - protein, 43 aa, Artificial Sequence
  Synthetic Construct
EEEEEESGGGGSGGGGSGGGGGLSKGCFGLKLDRIGSMSGLGC

SEQ ID NO: 130 - protein, 43 aa, Artificial Sequence
  Synthetic Construct
EEEEEEASTSPANPQPAASSPGLSKGCFGLKLDRIGSMSGLGC

SEQ ID NO: 131 - protein, 43 aa, Artificial Sequence
  Synthetic Construct
EEEEEEPSSAAPQPNAPSTSAGLSKGCFGLKLDRIGSMSGLGC

SEQ ID NO: 132 - protein, 43 aa, Artificial Sequence
  Synthetic Construct
EEEEEESGGGGSGGGKGANKKGLSKGCFGLKLDRIGSMSGLGC

SEQ ID NO: 133 - protein, 43 aa, Artificial Sequence
  Synthetic Construct
EEEEEESGGGGSGGGQGANQQGLSKGCFGLKLDRIGSMSGLGC

SEQ ID NO: 134 - protein, 43 aa, Artificial Sequence
  Synthetic Construct
EEEEEESGGGGSGGGKGANKQGLSKGCFGLKLDRIGSMSGLGC

SEQ ID NO: 135 - protein, 43 aa, Artificial Sequence
  Synthetic Construct
EEEEEESGGGGSGGGKGANQKGLSKGCFGLKLDRIGSMSGLGC

SEQ ID NO: 136 - protein, 43 aa, Artificial Sequence
  Synthetic Construct
EEEEEESGGGGSGGGQGANKKGLSKGCFGLKLDRIGSMSGLGC

SEQ ID NO: 137 - protein, 43 aa, Artificial Sequence
  Synthetic Construct
EEEEEESGGGGSGGGKGANQQGLSKGCFGLKLDRIGSMSGLGC

SEQ ID NO: 138 - protein, 43 aa, Artificial Sequence
  Synthetic Construct
EEEEEESGGGGSGGGQGANQKGLSKGCFGLKLDRIGSMSGLGC

SEQ ID NO: 139 - protein, 43 aa, Artificial Sequence
  Synthetic Construct
EEEEEESGGGGSGGGQGANKQGLSKGCFGLKLDRIGSMSGLGC

SEQ ID NO: 140 - protein, 43 aa, Artificial Sequence
  Synthetic Construct
DDDDDDQEHPNARKYKGANKKGLSKGCFGLKLDRIGSMSGLGC

SEQ ID NO: 141 - protein, 43 aa, Artificial Sequence
  Synthetic Construct
DDDDDDSGGGGSGGGGSGGGGGLSKGCFGLKLDRIGSMSGLGC

SEQ ID NO: 142 - protein, 43 aa, Artificial Sequence
  Synthetic Construct
DDDDDDASTSPANPQPAASSGGLSKGCFGLKLDRIGSMSGLGC

SEQ ID NO: 143 - protein, 43 aa, Artificial Sequence
  Synthetic Construct
DDDDDDGSSAAPQPNAPSTSAGLSKGCFGLKLDRIGSMSGLGC

SEQ ID NO: 144 - protein, 43 aa, Artificial Sequence
  Synthetic Construct
DDDDDDSGGGGSGGGKGANKKGLSKGCFGLKLDRIGSMSGLGC

SEQ ID NO: 145 - protein, 43 aa, Artificial Sequence
  Synthetic Construct
DDDDDDSGGGGSGGGQGANQQGLSKGCFGLKLDRIGSMSGLGC

SEQ ID NO: 146 - protein, 43 aa, Artificial Sequence
  Synthetic Construct
DDDDDDSGGGGSGGGKGANQKGLSKGCFGLKLDRIGSMSGLGC

SEQ ID NO: 147 - protein, 42 aa, Artificial Sequence
  Synthetic Construct
DDDDDDGGGGSGGGGSGGGGGLSKGCFGLKLDRIGSMSGLGC

SEQ ID NO: 148 - protein, 42 aa, Artificial Sequence
  Synthetic Construct
GLSKGCFGLKLDRIGSMSGLGCGGGGSGGGGSGGGGDDDDDD

SEQ ID NO: 149 - protein, 37 aa, Artificial Sequence
  Synthetic Construct
GSSAAPRPNAPSTSAGLSKGCFGLKLDRIGSMSGLGC

SEQ ID NO: 150 - protein, 37 aa, Artificial Sequence
  Synthetic Construct
ASTSPANPRPAASSGGLSKGCFGLKLDRIGSMSGLGC

SEQ ID NO: 151 - protein, 29 aa, Artificial Sequence
  Synthetic Construct
GLSKGCFGLKLDRIGSMSGLGCPSSAARR

SEQ ID NO: 152 - protein, 42 aa, Artificial Sequence
  Synthetic Construct
HGPQGQEHPNARKYKGANKKGLSKGCFGLKLDRIGSMSGLGC

SEQ ID NO: 153 - protein, 48 aa, Artificial Sequence
  Synthetic Construct
EEEEEEHGPQGQEHPNARKYKGANKKGLSKGCFGLKLDRIGSMSGLGC

SEQ ID NO: 154 - protein, 42 aa, Artificial Sequence
  Synthetic Construct
HKLRGQEHPNARKYKGANKKGLSKGCFGLKLDRIGSMSGLGC

SEQ ID NO: 155 - protein, 48 aa, Artificial Sequence
  Synthetic Construct
EEEEEEHKLRGQEHPNARKYKGANKKGLSKGCFGLKLDRIGSMSGLGC

SEQ ID NO: 156 - protein, 22 aa, Artificial Sequence
  Synthetic Construct
GLSKGCFGLKLDRIGSESGLGC

SEQ ID NO: 157 - protein, 22 aa, Artificial Sequence
  Synthetic Construct
GLSKGCFGLKLDRIGSRSGLGC

SEQ ID NO: 158 - protein, 22 aa, Artificial Sequence
  Synthetic Construct
GLSKGCFGLKLDRIGSYSGLGC

SEQ ID NO: 159 - protein, 22 aa, Artificial Sequence
  Synthetic Construct
GLSKGCFGLKLDRIGSCSGLGC

SEQ ID NO: 160 - protein, 22 aa, Artificial Sequence
  Synthetic Construct
GLSKGCFGLKLDRIGSPSGLGC

SEQ ID NO: 161 - protein, 22 aa, Artificial Sequence
  Synthetic Construct
GLSKGCFGLKLDRIGSDSGLGC

SEQ ID NO: 162 - protein, 37 aa, Artificial Sequence
  Synthetic Construct
  MISC_FEATURE (32)..(32): Xaa can be any naturally occurring amino acid, including but not limited to Phe, Leu, Ile, Thr, Glu, Arg, Tyr, Cys, Pro, or Asp
QEHPNARKYKGANKKGLSKGCFGLKLDRIGSXSGLGC

SEQ ID NO: 163 - protein, 37 aa, Artificial Sequence
  Synthetic Construct
QEHPNARKYKGANKKGLSKGCFGLKLDRIGSFSGLGC

SEQ ID NO: 164 - protein, 37 aa, Artificial Sequence
  Synthetic Construct
QEHPNARKYKGANKKGLSKGCFGLKLDRIGSLSGLGC

SEQ ID NO: 165 - protein, 37 aa, Artificial Sequence
  Synthetic Construct
QEHPNARKYKGANKKGLSKGCFGLKLDRIGSISGLGC

SEQ ID NO: 166 - protein, 37 aa, Artificial Sequence
  Synthetic Construct
QEHPNARKYKGANKKGLSKGCFGLKLDRIGSTSGLGC

SEQ ID NO: 167 - protein, 37 aa, Artificial Sequence
  Synthetic Construct
QEHPNARKYKGANKKGLSKGCFGLKLDRIGSESGLGC

SEQ ID NO: 168 - protein, 37 aa, Artificial Sequence
  Synthetic Construct
QEHPNARKYKGANKKGLSKGCFGLKLDRIGSRSGLGC

SEQ ID NO: 169 - protein, 37 aa, Artificial Sequence
  Synthetic Construct
QEHPNARKYKGANKKGLSKGCFGLKLDRIGSYSGLGC

SEQ ID NO: 170 - protein, 37 aa, Artificial Sequence
  Synthetic Construct
QEHPNARKYKGANKKGLSKGCFGLKLDRIGSCSGLGC

SEQ ID NO: 171 - protein, 37 aa, Artificial Sequence
  Synthetic Construct
QEHPNARKYKGANKKGLSKGCFGLKLDRIGSPSGLGC

SEQ ID NO: 172 - protein, 37 aa, Artificial Sequence
  Synthetic Construct
QEHPNARKYKGANKKGLSKGCFGLKLDRIGSDSGLGC

SEQ ID NO: 173 - protein, 42 aa, Artificial Sequence
  Synthetic Construct
  MISC_FEATURE (37)..(37): Xaa can be any naturally occurring amino acid, including but not limited to Phe, Leu, Ile, Thr, Glu, Arg, Tyr, Cys, Pro, or Asp
HGPQGQEHPNARKYKGANKKGLSKGCFGLKLDRIGSXSGLGC

SEQ ID NO: 174 - protein, 42 aa, Artificial Sequence
  Synthetic Construct
  MISC_FEATURE (37)..(37): Xaa can be any naturally occurring amino acid, including but not limited to Phe, Leu, Ile, Thr, Glu, Arg, Tyr, Cys, Pro, or Asp
SGGGGQEHPNARKYKGANKKGLSKGCFGLKLDRIGSXSGLGC

SEQ ID NO: 175 - protein, 45 aa, Artificial Sequence
  Synthetic Construct
  MISC_FEATURE (40)..(40): Xaa can be any naturally occurring amino acid, including but not limited to Phe, Leu, Ile, Thr, Glu, Arg, Tyr, Cys, Pro, or Asp
GGGHGPQGQEHPNARKYKGANKKGLSKGCFGLKLDRIGSXSGLGC

SEQ ID NO: 176 - protein, 45 aa, Artificial Sequence
  Synthetic Construct
  MISC_FEATURE (40)..(40): Xaa can be any naturally occurring amino acid, including but not limited to Phe, Leu, Ile, Thr, Glu, Arg, Tyr, Cys, Pro, or Asp
GGGSGGGGQEHPNARKYKGANKKGLSKGCFGLKLDRIGSXSGLGC

SEQ ID NO: 177 - protein, 42 aa, Artificial Sequence
  Synthetic Construct
  MISC_FEATURE (37)..(37): Xaa can be any naturally occurring amino acid, including but not limited to Phe, Leu, Ile, Thr, Glu, Arg, Tyr, Cys, Pro, or Asp
SGGGGSGGGGSGGGKGANKKGLSKGCFGLKLDRIGSXSGLGC

SEQ ID NO: 178 - protein, 42 aa, Artificial Sequence
  Synthetic Construct
  MISC_FEATURE (37)..(37): Xaa can be any naturally occurring amino acid, including but not limited to Phe, Leu, Ile, Thr, Glu, Arg, Tyr, Cys, Pro, or Asp
HGPQGSGGGGSGGGKGANKKGLSKGCFGLKLDRIGSXSGLGC

SEQ ID NO: 179 - protein, 45 aa, Artificial Sequence
  Synthetic Construct
  MISC_FEATURE (40)..(40): Xaa can be any naturally occurring amino acid, including but not limited to Phe, Leu, Ile, Thr, Glu, Arg, Tyr, Cys, Pro, or Asp
GGGSGGGGSGGGGSGGGKGANKKGLSKGCFGLKLDRIGSXSGLGC

SEQ ID NO: 180 - protein, 45 aa, Artificial Sequence
  Synthetic Construct
  MISC_FEATURE (40)..(40): Xaa can be any naturally occurring amino acid, including but not limited to Phe, Leu, Ile, Thr, Glu, Arg, Tyr, Cys, Pro, or Asp
GGGHGPQGSGGGGSGGGKGANKKGLSKGCFGLKLDRIGSXSGLGC

SEQ ID NO: 181 - protein, 42 aa, Artificial Sequence
  Synthetic Construct
  MISC_FEATURE (37)..(37): Xaa can be any naturally occurring amino acid, including but not limited to Phe, Leu, Ile, Thr, Glu, Arg, Tyr, Cys, Pro, or Asp
HKLRGQEHPNARKYKGANKKGLSKGCFGLKLDRIGSXSGLGC

SEQ ID NO: 182 - protein, 45 aa, Artificial Sequence
  Synthetic Construct
  MISC_FEATURE (40)..(40): Xaa can be any naturally occurring amino acid, including but not limited to Phe, Leu, Ile, Thr, Glu, Arg, Tyr, Cys, Pro, or Asp
GGGHKLRGQEHPNARKYKGANKKGLSKGCFGLKLDRIGSXSGLGC

SEQ ID NO: 183 - protein, 42 aa, Artificial Sequence
  Synthetic Construct
  MISC_FEATURE (37)..(37): Xaa can be any naturally occurring amino acid, including but not limited to Phe, Leu, Ile, Thr, Glu, Arg, Tyr, Cys, Pro, or Asp
HKLRGSGGGGSGGGKGANKKGLSKGCFGLKLDRIGSXSGLGC

SEQ ID NO: 184 - protein, 45 aa, Artificial Sequence
  Synthetic Construct
  MISC_FEATURE (40)..(40): Xaa can be any naturally occurring amino acid, including but not limited to Phe, Leu, Ile, Thr, Glu, Arg, Tyr, Cys, Pro, or Asp
GGGHKLRGSGGGGSGGGKGANKKGLSKGCFGLKLDRIGSXSGLGC

SEQ ID NO: 185 - protein, 39 aa, Artificial Sequence
  Synthetic Construct
  MISC_FEATURE (34)..(34): Xaa can be any naturally occurring amino acid, including but not limited to Phe, Leu, Ile, Thr, Glu, Arg, Tyr, Cys, Pro, or Asp
PGQEHPNARKYKGANKKGLSKGCFGLKLDRIGSXSGLGC

SEQ ID NO: 186 - protein, 48 aa, Artificial Sequence
  Synthetic Construct
  MISC_FEATURE (43)..(43): Xaa can be any naturally occurring amino acid, including but not limited to Phe, Leu, Ile, Thr, Glu, Arg, Tyr, Cys, Pro, or Asp
EEEEEEHGPQGQEHPNARKYKGANKKGLSKGCFGLKLDRIGSXSGLGC

SEQ ID NO: 187 - protein, 48 aa, Artificial Sequence
  Synthetic Construct
  MISC_FEATURE (43)..(43): Xaa can be any naturally occurring amino acid, including but not limited to Phe, Leu, Ile, Thr, Glu, Arg, Tyr, Cys, Pro, or Asp
EEEEEESGGGGQEHPNARKYKGANKKGLSKGCFGLKLDRIGSXSGLGC

SEQ ID NO: 188 - protein, 51 aa, Artificial Sequence
  Synthetic Construct
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGHGPQGQEHPNARKYKGANKKGLSKGCFGLKLDRIGSXSGLGC

SEQ ID NO: 189 - protein, 51 aa, Artificial Sequence
  Synthetic Construct
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGSGGGGQEHPNARKYKGANKKGLSKGCFGLKLDRIGSXSGLGC

SEQ ID NO: 190 - protein, 48 aa, Artificial Sequence
  Synthetic Construct
  MISC_FEATURE (43)..(43): Xaa can be any naturally occurring amino acid, including but not limited to Phe, Leu, Ile, Thr, Glu, Arg, Tyr, Cys, Pro, or Asp
EEEEEESGGGGSGGGGSGGGKGANKKGLSKGCFGLKLDRIGSXSGLGC

SEQ ID NO: 191 - protein, 48 aa, Artificial Sequence
  Synthetic Construct
  MISC_FEATURE (43)..(43): Xaa can be any naturally occurring amino acid, including but not limited to Phe, Leu, Ile, Thr, Glu, Arg, Tyr, Cys, Pro, or Asp
EEEEEEHGPQGSGGGGSGGGKGANKKGLSKGCFGLKLDRIGSXSGLGC

SEQ ID NO: 192 - protein, 51 aa, Artificial Sequence
  Synthetic Construct
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGSGGGGSGGGGSGGGKGANKKGLSKGCFGLKLDRIGSXSGLGC

SEQ ID NO: 193 - protein, 51 aa, Artificial Sequence
  Synthetic Construst
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGHGPQGSGGGGSGGGKGANKKGLSKGCFGLKLDRIGSXSGLGC

SEQ ID NO: 194 - protein, 48 aa, Artificial Sequence
  Synthetic Construct
  MISC_FEATURE (43)..(43): Xaa can be any naturally occurring amino acid, including but not limited to Phe, Leu, Ile, Thr, Glu, Arg, Tyr, Cys, Pro, or Asp
EEEEEEHKLRGQEHPNARKYKGANKKGLSKGCFGLKLDRIGSXSGLGC

SEQ ID NO: 195 - protein, 51 aa, Artificial Sequence
  Synthetic Construct
  MISC_FEATURE (46)..(46): XXaa can be any naturally occurring amino acid, including but not limited to Phe, Leu, Ile, Thr, Glu, Arg, Tyr, Cys, Pro, or Asp
EEEEEEGGGHKLRGQEHPNARKYKGANKKGLSKGCFGLKLDRIGSXSGLGC

SEQ ID NO: 196 - protein, 48 aa, Artificial Sequence
  Synthetic Construct
  MISC_FEATURE (43)..(43): Xaa can be any naturally occurring amino acid, including but not limited to Phe, Leu, Ile, Thr, Glu, Arg, Tyr, Cys, Pro, or Asp
EEEEEEHKLRGSGGGGSGGGKGANKKGLSKGCFGLKLDRIGSXSGLGC

SEQ ID NO: 197 - protein, 51 aa, Artificial Sequence
  Synthetic Construct
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGHKLRGSGGGGSGGGKGANKKGLSKGCFGLKLDRIGSXSGLGC

SEQ ID NO: 198 - protein, 45 aa, Artificial Sequence
  Synthetic Construct
  MISC_FEATURE (40)..(40): Xaa can be any naturally occurring amino acid, including but not limited to Phe, Leu, Ile, Thr, Glu, Arg, Tyr, Cys, Pro, or Asp
EEEEEEPGQEHPNARKYKGANKKGLSKGCFGLKLDRIGSXSGLGC

SEQ ID NO: 199 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGGSGGGGGLSKGCFGLKLDRIGSXSGLGC

SEQ ID NO: 200 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEEASTSPANPQPAASSPGLSKGCFGLKLDRIGSXSGLGC

SEQ ID NO: 201 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEEPSSAAPQPNAPSTSAGLSKGCFGLKLDRIGSXSGLGC

SEQ ID NO: 202 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGKGANKKGLSKGCFGLKLDRIGSXSGLGC

SEQ ID NO: 203 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGQGANQQGLSKGCFGLKLDRIGSXSGLGC

SEQ ID NO: 204 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGKGANKQGLSKGCFGLKLDRIGSXSGLGC

SEQ ID NO: 205 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGKGANQKGLSKGCFGLKLDRIGSXSGLGC

SEQ ID NO: 206 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGQGANKKGLSKGCFGLKLDRIGSXSGLGC

SEQ ID NO: 207 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGKGANQQGLSKGCFGLKLDRIGSXSGLGC

SEQ ID NO: 208 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGQGANQKGLSKGCFGLKLDRIGSXSGLGC

SEQ ID NO: 209 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGQGANKQGLSKGCFGLKLDRIGSXSGLGC

SEQ ID NO: 210 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDQEHPNARKYKGANKKGLSKGCFGLKLDRIGSXSGLGC

SEQ ID NO: 211 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDSGGGGSGGGGSGGGGGLSKGCFGLKLDRIGSXSGLGC

SEQ ID NO: 212 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDASTSPANPQPAASSGGLSKGCFGLKLDRIGSXSGLGC

SEQ ID NO: 213 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDGSSAAPQPNAPSTSAGLSKGCFGLKLDRIGSXSGLGC

SEQ ID NO: 214 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDSGGGGSGGGKGANKKGLSKGCFGLKLDRIGSXSGLGC

SEQ ID NO: 215 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDSGGGGSGGGQGANQQGLSKGCFGLKLDRIGSXSGLGC

SEQ ID NO: 216 - protein, 43 aa, Artificial Sequence
  Synthetic Construct
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDSGGGGSGGGKGANQKGLSKGCFGLKLDRIGSXSGLGC

SEQ ID NO: 217 - protein, 42 aa, Artificial Sequence
  Synthetic Construct
  MISC_FEATURE (37)..(37): Xaa can be any naturally occurring amino acid, including but not limited to Phe, Leu, Ile, Thr, Glu, Arg, Tyr, Cys, Pro, or Asp
DDDDDDGGGGSGGGGSGGGGGLSKGCFGLKLDRIGSXSGLGC

SEQ ID NO: 218 - protein, 42 aa, Artificial Sequence
  Synthetic Construct
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCGGGGSGGGGSGGGGDDDDDD

SEQ ID NO: 219 - protein, 37 aa, Artificial Sequence
  Synthetic Construct
  MISC_FEATURE (32)..(32): Xaa can be any naturally occurring amino acid, including but not limited to Phe, Leu, Ile, Thr, Glu, Arg, Tyr, Cys, Pro, or Asp
GSSAAPRPNAPSTSAGLSKGCFGLKLDRIGSXSGLGC

SEQ ID NO: 220 - protein, 37 aa, Artificial Sequence
  Synthetic Construct
  MISC_FEATURE (32)..(32): Xaa can be any naturally occurring amino acid, including but not limited to Phe, Leu, Ile, Thr, Glu, Arg, Tyr, Cys, Pro, or Asp
ASTSPANPRPAASSGGLSKGCFGLKLDRIGSXSGLGC

SEQ ID NO: 221 - protein, 48 aa, Artificial Sequence
  Synthetic Construct
EEEEEEHGPQGQEHPNARKYKGANKKGLSKGCFGLKLDRIGSLSGLGC

SEQ ID NO: 222 - protein, 48 aa, Artificial Sequence
  Synthetic Construct
EEEEEESGGGGQEHPNARKYKGANKKGLSKGCFGLKLDRIGSLSGLGC

SEQ ID NO: 223 - protein, 51 aa, Artificial Sequence
  Synthetic Construct
EEEEEEGGGHGPQGQEHPNARKYKGANKKGLSKGCFGLKLDRIGSLSGLGC

SEQ ID NO: 224 - protein, 51 aa, Artificial Sequence
  Synthetic Construct
EEEEEEGGGSGGGGQEHPNARKYKGANKKGLSKGCFGLKLDRIGSLSGLGC

SEQ ID NO: 225 - protein, 48 aa, Artificial Sequence
  Synthetic Construct
EEEEEESGGGGSGGGGSGGGKGANKKGLSKGCFGLKLDRIGSLSGLGC

SEQ ID NO: 226 - protein, 48 aa, Artificial Sequence
  Synthetic Construct
EEEEEEHGPQGSGGGGSGGGKGANKKGLSKGCFGLKLDRIGSLSGLGC

SEQ ID NO: 227 - protein, 51 aa, Artificial Sequence
  Synthetic Construct
EEEEEEGGGSGGGGSGGGGSGGGKGANKKGLSKGCFGLKLDRIGSLSGLGC

SEQ ID NO: 228 - protein, 51 aa, Artificial Sequence
  Synthetic Construct
EEEEEEGGGHGPQGSGGGGSGGGKGANKKGLSKGCFGLKLDRIGSLSGLGC

SEQ ID NO: 229 - protein, 48 aa, Artificial Sequence
  Synthetic Construct
EEEEEEHKLRGQEHPNARKYKGANKKGLSKGCFGLKLDRIGSLSGLGC

SEQ ID NO: 230 - protein, 51 aa, Artificial Sequence
  Synthetic Construct
EEEEEEGGGHKLRGQEHPNARKYKGANKKGLSKGCFGLKLDRIGSLSGLGC

SEQ ID NO: 231 - protein, 48 aa, Artificial Sequence
  Synthetic Construct
EEEEEEHKLRGSGGGGSGGGKGANKKGLSKGCFGLKLDRIGSLSGLGC

SEQ ID NO: 232 - protein, 51 aa, Artificial Sequence
  Synthetic Construct
EEEEEEGGGHKLRGSGGGGSGGGKGANKKGLSKGCFGLKLDRIGSLSGLGC

SEQ ID NO: 233 - protein, 45 aa, Artificial Sequence
  Synthetic Construct
EEEEEEPGQEHPNARKYKGANKKGLSKGCFGLKLDRIGSLSGLGC

SEQ ID NO: 234-300 - skipped (67 entries)

SEQ ID NO: 301 - protein, 1 aa, Artificial Sequence
  Synthetic Construct
G

SEQ ID NO: 302 - protein, 2 aa, Artificial Sequence
  Synthetic Construct
GG

SEQ ID NO: 303 - protein, 3 aa, Artificial Sequence
  Synthetic Construct
GGG

SEQ ID NO: 304 - protein, 4 aa, Artificial Sequence
  Synthetic Construct
GGGG

SEQ ID NO: 305 - protein, 5 aa, Artificial Sequence
  Synthetic Construct
GGGGS

SEQ ID NO: 306 - protein, 6 aa, Artificial Sequence
  Synthetic Construct
GGGGSG

SEQ ID NO: 307 - protein, 14 aa, Artificial Sequence
  Synthetic Construct
GGGGSGGGGSGGGG

SEQ ID NO: 308 - protein, 16 aa, Artificial Sequence
  Synthetic Construct
GGGGSGGGGSGGGGSG

SEQ ID NO: 309 - protein, 22 aa, Artificial Sequence
  Synthetic Construct
GGGGSGGGGSGGGGSGGGGSGG

SEQ ID NO: 310 - protein, 28 aa, Artificial Sequence
  Synthetic Construct
GGGGSGGGGSGGGGSGGGGSGGGGSGGG

SEQ ID NO: 311 - protein, 34 aa, Artificial Sequence
  Synthetic Construct
GGGGSGGGGSGGGGSGGGGSGGGGSGGGGSGGGG

SEQ ID NO: 312 - protein, 40 aa, Artificial Sequence
  Synthetic Construct
GGGGSGGGGSGGGGSGGGGSGGGGSGGGGSGGGGSGGGGS

SEQ ID NO: 313 - protein, 46 aa, Artificial Sequence
  Synthetic Construct
GGGGSGGGGSGGGGSGGGGSGGGGSGGGGSGGGGSGGGGSGGGGSG

SEQ ID NO: 314 - protein, 6 aa, Artificial Sequence
  Synthetic Construct
KGANKK

SEQ ID NO: 315 - protein, 6 aa, Artificial Sequence
  Synthetic Construct
KGANQK

SEQ ID NO: 316 - protein, 6 aa, Artificial Sequence
  Synthetic Construct
KGANKQ

SEQ ID NO: 317 - protein, 6 aa, Artificial Sequence
  Synthetic Construct
KGANQQ

SEQ ID NO: 318 - protein, 6 aa, Artificial Sequence
  Synthetic Construct
QGANKK

SEQ ID NO: 319 - protein, 6 aa, Artificial Sequence
  Synthetic Construct
QGANQK

SEQ ID NO: 320 - protein, 6 aa, Artificial Sequence
  Synthetic Construct
QGANKQ

SEQ ID NO: 321 - protein, 6 aa, Artificial Sequence
  Synthetic Construct
QGANQQ

SEQ ID NO: 322 - protein, 16 aa, Artificial Sequence
  Synthetic Construct
GGGGSGGGGSKGANKK

SEQ ID NO: 323 - protein, 16 aa, Artificial Sequence
  Synthetic Construct
GGGGSGGGGSKGANQK

SEQ ID NO: 324 - protein, 16 aa, Artificial Sequence
  Synthetic Construct
GGGGSGGGGSKGANKQ

SEQ ID NO: 325 - protein, 16 aa, Artificial Sequence
  Synthetic Construct
GGGGSGGGGSKGANQQ

SEQ ID NO: 326 - protein, 16 aa, Artificial Sequence
  Synthetic Construct
GGGGSGGGGSQGANKK

SEQ ID NO: 327 - protein, 16 aa, Artificial Sequence
  Synthetic Construct
GGGGSGGGGSQGANQK

SEQ ID NO: 328 - protein, 16 aa, Artificial Sequence
  Synthetic Construct
GGGGSGGGGSQGANKQ

SEQ ID NO: 329 - protein, 16 aa, Artificial Sequence
  Synthetic Construct
GGGGSGGGGSQGANQQ

SEQ ID NO: 330 - protein, 34 aa, Artificial Sequence
  Synthetic Construct
GGGDLQVDTQSQAAWAQLLQEHPNAQQYKGANKK

SEQ ID NO: 331 - protein, 34 aa, Artificial Sequence
  Synthetic Construct
GGGGSGGGGSGGGGSGGGGSGGGGSGGGKGANKK

SEQ ID NO: 332 - protein, 34 aa, Artificial Sequence
  Synthetic Construct
GGGGSGGGGSGGGGSGGGGSGGGGSGGGKGANQK

SEQ ID NO: 333 - protein, 34 aa, Artificial Sequence
  Synthetic Construct
GGGGSGGGGSGGGGSGGGGSGGGGSGGGQGANQQ

SEQ ID NO: 334 - protein, 15 aa, Artificial Sequence
  Synthetic Construct
QEHPNARKYKGANKK

SEQ ID NO: 335 - protein, 16 aa, Artificial Sequence
  Synthetic Construct
GQEHPNARKYKGANKK

SEQ ID NO: 336 - protein, 17 aa, Artificial Sequence
  Synthetic Construct
PGQEHPNARKYKGANKK

SEQ ID NO: 337 - protein, 15 aa, Artificial Sequence
  Synthetic Construct
SGGGGSGGGGSGGGG

SEQ ID NO: 338 - protein, 15 aa, Artificial Sequence
  Synthetic Construct
ASTSPANPQPAASSP

SEQ ID NO: 339 - protein, 15 aa, Artificial Sequence
  Synthetic Construct
PSSAAPQPNAPSTSA

SEQ ID NO: 340 - protein, 15 aa, Artificial Sequence
  Synthetic Construct
SGGGGSGGGKGANKK

SEQ ID NO: 341 - protein, 15 aa, Artificial Sequence
  Synthetic Construct
SGGGGSGGGQGANQQ

SEQ ID NO: 342 - protein, 15 aa, Artificial Sequence
  Synthetic Construct
SGGGGSGGGKGANKQ

SEQ ID NO: 343 - protein, 15 aa, Artificial Sequence
  Synthetic Construct
SGGGGSGGGKGANQK

SEQ ID NO: 344 - protein, 15 aa, Artificial Sequence
  Synthetic Construct
SGGGGSGGGQGANKK

SEQ ID NO: 345 - protein, 15 aa, Artificial Sequence
  Synthetic Construct
SGGGGSGGGKGANQQ

SEQ ID NO: 346 - protein, 15 aa, Artificial Sequence
  Synthetic Construct
SGGGGSGGGQGANQK

SEQ ID NO: 347 - protein, 15 aa, Artificial Sequence
  Synthetic Construct
SGGGGSGGGQGANKQ

SEQ ID NO: 348 - protein, 15 aa, Artificial Sequence
  Synthetic Construct
ASTSPANPQPAASSG

SEQ ID NO: 349 - protein, 15 aa, Artificial Sequence
  Synthetic Construct
GSSAAPQPNAPSTSA

SEQ ID NO: 350 - protein, 20 aa, Artificial Sequence
  Synthetic Construct
GSSAAPRPNAPSTSAGLSKG

SEQ ID NO: 351 - protein, 15 aa, Artificial Sequence
  Synthetic Construct
ASTSPANPRPAASSG

SEQ ID NO: 352 - protein, 20 aa, Artificial Sequence
  Synthetic Construct
HGPQGQEHPNARKYKGANKK

SEQ ID NO: 353 - protein, 20 aa, Artificial Sequence
  Synthetic Construct
HKLRGQEHPNARKYKGANKK

SEQ ID NO: 354 - protein, 21 aa, Artificial Sequence
  Synthetic Construct
GHGPQGQEHPNARKYKGANKK

SEQ ID NO: 355 - protein, 21 aa, Artificial Sequence
  Synthetic Construct
GHKLRGQEHPNARKYKGANKK

SEQ ID NO: 356 - protein, 22 aa, Artificial Sequence
  Synthetic Construct
GGHGPQGQEHPNARKYKGANKK

SEQ ID NO: 357 - protein, 22 aa, Artificial Sequence
  Synthetic Construct
GGHKLRGQEHPNARKYKGANKK

SEQ ID NO: 358 - protein, 23 aa, Artificial Sequence
  Synthetic Construct
GGGHGPQGQEHPNARKYKGANKK

SEQ ID NO: 359 - protein, 23 aa, Artificial Sequence
  Synthetic Construct
GGGHKLRGQEHPNARKYKGANKK

SEQ ID NO: 360 - protein, 24 aa, Artificial Sequence
  Synthetic Construct
GGGGHGPQGQEHPNARKYKGANKK

SEQ ID NO: 361 - protein, 24 aa, Artificial Sequence
  Synthetic Construct
GGGGHKLRGQEHPNARKYKGANKK

SEQ ID NO: 362 - protein, 25 aa, Artificial Sequence
  Synthetic Construct
GGGGGHGPQGQEHPNARKYKGANKK

SEQ ID NO: 363 - protein, 25 aa, Artificial Sequence
  Synthetic Construct
GGGGGHKLRGQEHPNARKYKGANKK

SEQ ID NO: 364 - protein, 20 aa, Artificial Sequence
  Synthetic Construct
HGPQGSGGGGSGGGKGANKK

SEQ ID NO: 365 - protein, 20 aa, Artificial Sequence
  Synthetic Construct
HKLRGSGGGGSGGGKGANKK

SEQ ID NO: 366 - protein, 23 aa, Artificial Sequence
  Synthetic Construct
GGGHGPQGSGGGGSGGGKGANKK

SEQ ID NO: 367 - protein, 23 aa, Artificial Sequence
  Synthetic Construct
GGGHKLRGSGGGGSGGGKGANKK

SEQ ID NO: 368 - protein, 20 aa, Artificial Sequence
  Synthetic Construct
SGGGGQEHPNARKYKGANKK

SEQ ID NO: 369 - protein, 23 aa, Artificial Sequence
  Synthetic Construct
GGGSGGGGQEHPNARKYKGANKK

SEQ ID NO: 370 - protein, 20 aa, Artificial Sequence
  Synthetic Construct
SGGGGSGGGGSGGGKGANKK

SEQ ID NO: 371 - protein, 25 aa, Artificial Sequence
  Synthetic Construct
SGGGGSGGGGSGGGGSGGGKGANKK

SEQ ID NO: 372 - protein, 23 aa, Artificial Sequence
  Synthetic Construct
GGGSGGGGSGGGGSGGGKGANKK

SEQ ID NO: 373 - protein, 28 aa, Artificial Sequence
  Synthetic Construct
GGGSGGGGSGGGGSGGGGSGGGKGANKK

SEQ ID NO: 374 - protein, 5 aa, Artificial Sequence
  Synthetic Construct
HGPQG

SEQ ID NO: 375 - protein, 5 aa, Artificial Sequence
  Synthetic Construct
HKLRG

SEQ ID NO: 376 - protein, 6 aa, Artificial Sequence
  Synthetic Construct
GHGPQG

SEQ ID NO: 377 - protein, 7 aa, Artificial Sequence
  Synthetic Construct
GGHGPQG

SEQ ID NO: 378 - protein, 8 aa, Artificial Sequence
  Synthetic Construct
GGGHGPQG

SEQ ID NO: 379 - protein, 9 aa, Artificial Sequence
  Synthetic Construct
GGGGHGPQG

SEQ ID NO: 380 - protein, 10 aa, Artificial Sequence
  Synthetic Construct
GGGGGHGPQG

SEQ ID NO: 381 - protein, 6 aa, Artificial Sequence
  Synthetic Construct
GHKLRG

SEQ ID NO: 382 - protein, 7 aa, Artificial Sequence
  Synthetic Construct
GGHKLRG

SEQ ID NO: 383 - protein, 8 aa, Artificial Sequence
  Synthetic Construct
GGGHKLRG

SEQ ID NO: 384 - protein, 9 aa, Artificial Sequence
  Synthetic Construct
GGGGHKLRG

SEQ ID NO: 385 - protein, 10 aa, Artificial Sequence
  Synthetic Construct
GGGGGHKLRG

SEQ ID NO: 386 - protein, 17 aa, Artificial Sequence
  Synthetic Construct
GGQEHPNARKYKGANKK

SEQ ID NO: 387 - protein, 18 aa, Artificial Sequence
  Synthetic Construct
GGGQEHPNARKYKGANKK

SEQ ID NO: 388 - protein, 19 aa, Artificial Sequence
  Synthetic Construct
GGGGQEHPNARKYKGANKK

SEQ ID NO: 389 - protein, 20 aa, Artificial Sequence
  Synthetic Construct
GGGGGQEHPNARKYKGANKK

SEQ ID NO: 390 - protein, 2 aa, Artificial Sequence
  Synthetic Construct
LK

SEQ ID NO: 391 - protein, 2 aa, Artificial Sequence
  Synthetic Construct
DI

SEQ ID NO: 392-400 - skipped (9 entries)

SEQ ID NO: 401 - protein, 227 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402-500 - skipped (99 entries)

SEQ ID NO: 501 - protein, 314 aa, Artificial Sequence
  Synthetic Construct
MGVHECPAWLWLLLSLLSLWPGAYAASWSHPQFEQSGGGGGENLYFQGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 502 - protein, 289 aa, Artificial Sequence
  Synthetic Construct
ASWSHPQFEQSGGGGGENLYFQGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 503 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 504 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 505 - protein, 296 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGLSKGCFGLKLDRIGSMSGLGC

SEQ ID NO: 506 - protein, 271 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGLSKGCFGLKLDRIGSMSGLGC

SEQ ID NO: 507 - protein, 302 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGLSKGCFGLKLDRIGSMSGLGC

SEQ ID NO: 508 - protein, 277 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGLSKGCFGLKLDRIGSMSGLGC

SEQ ID NO: 509 - protein, 308 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSGGGGGLSKGCFGLKLDRIGSMSGLGC

SEQ ID NO: 510 - protein, 283 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSGGGGGLSKGCFGLKLDRIGSMSGLGC

SEQ ID NO: 511 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSMSGLGC

SEQ ID NO: 512 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSMSGLGC

SEQ ID NO: 513 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSMSGLGC

SEQ ID NO: 514 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSMSGLGC

SEQ ID NO: 515 - protein, 308 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSMSGLGC

SEQ ID NO: 516 - protein, 283 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSMSGLGC

SEQ ID NO: 517 - protein, 308 aa, Artificial Sequence [sequence omitted]

SEQ ID NO: 518 - protein, 283 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANKKGLSKGCFGLKLDRIGSASGLGC

SEQ ID NO: 519 - protein, 308 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANAAGLSKGCFGLKLDRIGSASGLGC

SEQ ID NO: 520 - protein, 283 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANAAGLSKGCFGLKLDRIGSASGLGC

SEQ ID NO: 521 - protein, 285 aa, Artificial Sequence
  Synthetic Construct
GLSKGCFGLKLDRIGSMSGLGCGGGGSGGGGSGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGENLYFQGSHHHHHHHHHH

SEQ ID NO: 522 - protein, 275 aa, Artificial Sequence
  Synthetic Construct
GLSKGCFGLKLDRIGSMSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGENLYFQGSHHHHHHHHHH

SEQ ID NO: 523 - protein, 255 aa, Artificial Sequence
  Synthetic Construct
GLSKGCFGLKLDRIGSMSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 524 - protein, 264 aa, Artificial Sequence
  Synthetic Construct
GLSKGCFGLKLDRIGSMSGLGCPSLRDPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 525 - protein, 264 aa, Artificial Sequence
  Synthetic Construct
GLSKGCFGLKLDRIGSASGLGCPSSAAPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 526 - protein, 264 aa, Artificial Sequence
  Synthetic Construct
GLSKGCFGLKLDRIGSASGLGCPSSRAPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 527 - protein, 314 aa, Artificial Sequence
  Synthetic Construct
  MISC_FEATURE (309)..(309): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYAASWSHPQFEQSGGGGGENLYFQGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSXSGLGC

SEQ ID NO: 528 - protein, 289 aa, Artificial Sequence
  Synthetic Construct
  MISC_FEATURE (284)..(284): Xaa can be any naturally occurring amino acid, including but not limited to Phe, Leu, Ile, Thr, Glu, Arg, Tyr, Cys, Pro, or Asp
ASWSHPQFEQSGGGGGENLYFQGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSXSGLGC

SEQ ID NO: 529 - protein, 290 aa, Artificial Sequence
  Synthetic Construct
  MISC_FEATURE (285)..(285): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSXSGLGC

SEQ ID NO: 530 - protein, 265 aa, Artificial Sequence
  Synthetic Construct
  MISC_FEATURE (260)..(260): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSXSGLGC

SEQ ID NO: 531 - protein, 296 aa, Artificial Sequence
  Synthetic Construct
  MISC_FEATURE (291)..(291): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGLSKGCFGLKLDRIGSXSGLGC

SEQ ID NO: 532 - protein, 271 aa, Artificial Sequence
  Synthetic Construct
  MISC_FEATURE (266)..(266): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGLSKGCFGLKLDRIGSXSGLGC

SEQ ID NO: 533 - protein, 302 aa, Artificial Sequence
  Synthetic Construct
  MISC_FEATURE (297)..(297): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGLSKGCFGLKLDRIGSXSGLGC

SEQ ID NO: 534 - protein, 277 aa, Artificial Sequence
  Synthetic Construct
  MISC_FEATURE (272)..(272): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGLSKGCFGLKLDRIGSXSGLGC

SEQ ID NO: 535 - protein, 308 aa, Artificial Sequence
  Synthetic Construct
  MISC_FEATURE (303)..(303): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSGGGGGLSKGCFGLKLDRIGSXSGLGC

SEQ ID NO: 536 - protein, 283 aa, Artificial Sequence
  Synthetic Construct
  MISC_FEATURE (278)..(278): Xaa can be any naturally occurring amino acid
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSGGGGGLSKGCFGLKLDRIGSXSGLGC

SEQ ID NO: 537 - protein, 290 aa, Artificial Sequence
  Synthetic Construct
  MISC_FEATURE (285)..(285): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSXSGLGC

SEQ ID NO: 538 - protein, 265 aa, Artificial Sequence
  Synthetic Construct
  MISC_FEATURE (260)..(260): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSXSGLGC

SEQ ID NO: 539 - protein, 290 aa, Artificial Sequence
  Synthetic Construct
  MISC_FEATURE (285)..(285): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSXSGLGC

SEQ ID NO: 540 - protein, 265 aa, Artificial Sequence
  Synthetic Construct
  MISC_FEATURE (260)..(260): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSXSGLGC

SEQ ID NO: 541 - protein, 308 aa, Artificial Sequence
  Synthetic Construct
  MISC_FEATURE (303)..(303): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSXSGLGC

SEQ ID NO: 542 - protein, 283 aa, Artificial Sequence
  Synthetic Construct
  MISC_FEATURE (278)..(278): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSXSGLGC

SEQ ID NO: 543 - protein, 308 aa, Artificial Sequence
  Synthetic Construct
  MISC_FEATURE (303)..(303): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANKKGLSKGCFGLKLDRIGSXSGLGC

SEQ ID NO: 544 - protein, 283 aa, Artificial Sequence
  Synthetic Construct
  MISC_FEATURE (278)..(278): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANKKGLSKGCFGLKLDRIGSXSGLGC

SEQ ID NO: 545 - protein, 308 aa, Artificial Sequence
  Synthetic Construct
  MISC_FEATURE (303)..(303): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANAAGLSKGCFGLKLDRIGSXSGLGC

SEQ ID NO: 546 - protein, 283 aa, Artificial Sequence
  Synthetic Construct
  MISC_FEATURE (278)..(278): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANAAGLSKGCFGLKLDRIGSXSGLGC

SEQ ID NO: 547 - protein, 285 aa, Artificial Sequence
  Synthetic Construct
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCGGGGSGGGGSGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGENLYFQGSHHHHHHHHHH

SEQ ID NO: 548 - protein, 275 aa, Artificial Sequence
  Synthetic Construct
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGENLYFQGSHHHHHHHHHH

SEQ ID NO: 549 - protein, 255 aa, Artificial Sequence
  Synthetic Construct
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 550 - protein, 264 aa, Artificial Sequence
  Synthetic Construct
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCPSLRDPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 551 - protein, 264 aa, Artificial Sequence
  Synthetic Construct
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCPSSAAPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 552 - protein, 264 aa, Artificial Sequence
  Synthetic Construct
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCPSSRAPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 553 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSMSGLGC

SEQ ID NO: 554 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSMSGLGC

SEQ ID NO: 555 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSMSGLGC

SEQ ID NO: 556 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSMSGLGC

SEQ ID NO: 557 - protein, 318 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSMSGLGC

SEQ ID NO: 558 - protein, 293 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSMSGLGC

SEQ ID NO: 559 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSFSGLGC

SEQ ID NO: 560 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSFSGLGC

SEQ ID NO: 561 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSFSGLGC

SEQ ID NO: 562 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSFSGLGC

SEQ ID NO: 563 - protein, 308 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSFSGLGC

SEQ ID NO: 564 - protein, 283 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSFSGLGC

SEQ ID NO: 565 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSFSGLGC

SEQ ID NO: 566 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSFSGLGC

SEQ ID NO: 567 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSFSGLGC

SEQ ID NO: 568 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSFSGLGC

SEQ ID NO: 569 - protein, 318 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSFSGLGC

SEQ ID NO: 570 - protein, 293 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSFSGLGC

SEQ ID NO: 571 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSLSGLGC

SEQ ID NO: 572 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSLSGLGC

SEQ ID NO: 573 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSLSGLGC

SEQ ID NO: 574 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSLSGLGC

SEQ ID NO: 575 - protein, 308 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSLSGLGC

SEQ ID NO: 576 - protein, 283 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSLSGLGC

SEQ ID NO: 577 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSLSGLGC

SEQ ID NO: 578 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSLSGLGC

SEQ ID NO: 579 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSLSGLGC

SEQ ID NO: 580 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSLSGLGC

SEQ ID NO: 581 - protein, 318 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSLSGLGC

SEQ ID NO: 582 - protein, 293 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSLSGLGC

SEQ ID NO: 583 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSRSGLGC

SEQ ID NO: 584 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSRSGLGC

SEQ ID NO: 585 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSRSGLGC

SEQ ID NO: 586 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSRSGLGC

SEQ ID NO: 587 - protein, 308 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSRSGLGC

SEQ ID NO: 588 - protein, 283 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSRSGLGC

SEQ ID NO: 589 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSRSGLGC

SEQ ID NO: 590 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSRSGLGC

SEQ ID NO: 591 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSRSGLGC

SEQ ID NO: 592 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSRSGLGC

SEQ ID NO: 593 - protein, 318 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSRSGLGC

SEQ ID NO: 594 - protein, 293 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSRSGLGC

SEQ ID NO: 595 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSYSGLGC

SEQ ID NO: 596 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSYSGLGC

SEQ ID NO: 597 - protein, 290 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSYSGLGC

SEQ ID NO: 598 - protein, 265 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSYSGLGC

SEQ ID NO: 599 - protein, 308 aa, Artificial Sequence
  Synthetic Construct
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSYSGLGC

SEQ ID NO: 600 - protein, 283 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSYSGLGC

SEQ ID NO: 601 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSYSGLGC

SEQ ID NO: 602 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSYSGLGC

SEQ ID NO: 603 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSYSGLGC

SEQ ID NO: 604 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSYSGLGC

SEQ ID NO: 605 - protein, 318 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSYSGLGC

SEQ ID NO: 606 - protein, 293 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSYSGLGC

SEQ ID NO: 607 - protein, 300 aa, Artificial Sequence
  Synthetic Construct
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 608 - protein, 275 aa, Artificial Sequence
  Synthetic Construct
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 609-800 - skipped (192 entries)

SEQ ID NO: 801 - DNA, 945 bp, Artificial Sequence
  Synthetic Construct
atgggcgtgcacgagtgtcctgcctggctgtggctgctgctgagcctgctgtctctgtggcctggcgcctacgccgcctcttggagccacccccagtttgagcagtctggcggcggaggaggcgagaacctgtactttcagggcggcgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggaagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggcggactgagcaagggctgcttcggcctgaagctggaccggatcggcagcatgagcggcctgggctgctga

SEQ ID NO: 802 - DNA, 873 bp, Artificial Sequence
  Synthetic Construct
atgggcgtgcacgagtgtcctgcctggctgtggctgctgctgagcctgctgtctctgtggcctggcgcctacgccgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggcggactgagcaagggctgcttcggcctgaagctggaccggatcggcagcatgagcggcctgggctgctga

SEQ ID NO: 803 - DNA, 891 bp, Artificial Sequence
  Synthetic Construct
atgggcgtgcacgagtgtcctgcctggctgtggctgctgctgagcctgctgtctctgtggcctggcgcctacgccgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggaggcggaggatctggcggcggactgagcaagggctgcttcggcctgaagctggaccggatcggcagcatgagcggcctgggctgctga

SEQ ID NO: 804 - DNA, 909 bp, Artificial Sequence
  Synthetic Construct
atgggcgtgcacgagtgtcctgcctggctgtggctgctgctgagcctgctgtctctgtggcctggcgcctacgccgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggaggcggaggatctggcggcggaggaagtggcggaggcggactgagcaagggctgcttcggcctgaagctggaccggatcggcagcatgagcggcctgggctgctga

SEQ ID NO: 805 - DNA, 927 bp, Artificial Sequence
  Synthetic Construct
atgggcgtgcacgagtgtcctgcctggctgtggctgctgctgagcctgctgtctctgtggcctggcgcctacgccgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggaggcggaggatctggcggcggaggaagtggcggaggcggcagcggcggagggggaggactgagcaagggctgcttcggcctgaagctggaccggatcggcagcatgagcggcctgggctgctga

SEQ ID NO: 806 - DNA, 933 bp, Artificial Sequence
  Synthetic Construct
atgggcgtgcacgagtgtcctgcctggctgtggctgctgctgagcctgctgtctctgtggcctggcgcctacgccggcctgagcaagggctgcttcggcctgaagctggaccggatcggcagcatgtctggcctgggctgtggaggcggaggatctggcggcggaggaagtggcggaggcggcagcggcgataagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggcgagaacctgtactttcagggcagccaccaccatcaccatcaccaccatcatcactga

SEQ ID NO: 807-1000 - skipped (194 entries)

SEQ ID NO: 1001 - protein, 54 aa, Artificial Sequence
  Synthetic Construct
GDLRVDTKSRAAWARLLQEHPNARKYKGANKKGLSKGCFGLKLDRIGSMSGLGC

SEQ ID NO: 1002 - protein, 54 aa, Artificial Sequence
  Synthetic Construct
PDLRVDTKSRAAWARLLQEHPNARKYKGANKKGLSKGCFGLKLDRIGSMSGLGC

SEQ ID NO: 1003 - protein, 54 aa, Artificial Sequence
  Synthetic Construct
MDLRVDTKSRAAWARLLQEHPNARKYKGANKKGLSKGCFGLKLDRIGSMSGLGC

SEQ ID NO: 1004 - protein, 53 aa, Artificial Sequence
  Synthetic Construct
DLRVDTKSRAAWARLLQEHPNARKYKGANKKGLSKGCFGLKLDRIGSNSGLGC

SEQ ID NO: 1005 - protein, 52 aa, Artificial Sequence
  Synthetic Construct
LRVDTKSRAAWARLLQEHPNARKYKGANKKGLSKGCFGLKLDRIGSMSGLGC

SEQ ID NO: 1006 - protein, 51 aa, Artificial Sequence
  Synthetic Construct
RVDTKSRAAWARLLQEHPNARKYKGANKKGLSKGCFGLKLDRIGSMSGLGC

SEQ ID NO: 1007 - protein, 50 aa, Artificial Sequence
  Synthetic Construct
VDTKSRAAWARLLQEHPNARKYKGANKKGLSKGCFGLKLDRIGSMSGLGC

SEQ ID NO: 1008 - protein, 49 aa, Artificial Sequence
  Synthetic construct
DTKSRAAWARLLQEHPNARKYKGANKKGLSKGCFGLKLDRIGSMSGLGC

SEQ ID NO: 1009 - protein, 48 aa, Artificial Sequence
  Synthetic Construct
TKSRAAWARLLQEHPNARKYKGANKKGLSKGCFGLKLDRIGSMSGLGC

SEQ ID NO: 1010 - protein, 47 aa, Artificial Sequence
  Synthetic Construct
KSRAAWARLLQEHPNARKYKGANKKGLSKGCFGLKLDRIGSMSGLGC

SEQ ID NO: 1011 - protein, 46 aa, Artificial Sequence
  Synthetic Construct
SRAAWARLLQEHPNARKYKGANKKGLSKGCFGLKLDRIGSMSGLGC

SEQ ID NO: 1012 - protein, 45 aa, Artificial Sequence
  Synthetic Construct
RAAWARLLQEHPNARKYKGANKKGLSKGCFGLKLDRIGSMSGLGC

SEQ ID NO: 1013 - protein, 44 aa, Artificial Sequence
  Synthetic Construct
AAWARLLQEHPNARKYKGANKKGLSKGCFGLKLDRIGSMSGLGC

SEQ ID NO: 1014 - protein, 43 aa, Artificial Sequence
  Synthetic Construct
AWARLLQEHPNARKYKGANKKGLSKGCFGLKLDRIGSMSGLGC

SEQ ID NO: 1015 - protein, 42 aa, Artificial Sequence
  Synthetic Construct
WARLLQEHPNARKYKGANKKGLSKGCFGLKLDRIGSMSGLGC

SEQ ID NO: 1016 - protein, 41 aa, Artificial Sequence
  Synthetic Construct
ARLLQEHPNARKYKGANKKGLSKGCFGLKLDRIGSMSGLGC

SEQ ID NO: 1017 - protein, 40 aa, Artificial Sequence
  Synthetic Construct
RLLQEHPNARKYKGANKKGLSKGCFGLKLDRIGSMSGLGC

SEQ ID NO: 1018 - protein, 39 aa, Artificial Sequence
  Synthetic Construct
LLQEHPNARKYKGANKKGLSKGCFGLKLDRIGSMSGLGC

SEQ ID NO: 1019 - protein, 38 aa, Artificial Sequence
  Synthetic Construct
LQEHPNARKYKGANKKGLSKGCFGLKLDRIGSMSGLGC

SEQ ID NO: 1020 - protein, 36 aa, Artificial Sequence
  Synthetic Construct
EHPNARKYKGANKKGLSKGCFGLKLDRIGSMSGLGC

SEQ ID NO: 1021 - protein, 35 aa, Artificial Sequence
  Synthetic Construct
HPNARKYKGANKKGLSKGCFGLKLDRIGSMSGLGC

SEQ ID NO: 1022 - protein, 34 aa, Artificial Sequence
  Synthetic Construct
PNARKYKGANKKGLSKGCFGLKLDRIGSMSGLGC

SEQ ID NO: 1023 - protein, 33 aa, Artificial Sequence
  Synthetic Construct
NARKYKGANKKGLSKGCFGLKLDRIGSMSGLGC

SEQ ID NO: 1024 - protein, 32 aa, Artificial Sequence
  Synthetic Construct
ARKYKGANKKGLSKGCFGLKLDRIGSMSGLGC

SEQ ID NO: 1025 - protein, 31 aa, Artificial Sequence
  Synthetic Construct
RKYKGANKKGLSKGCFGLKLDRIGSMSGLGC

SEQ ID NO: 1026 - protein, 30 aa, Artificial Sequence
  Synthetic Construct
KYKGANKKGLSKGCFGLKLDRIGSMSGLGC

SEQ ID NO: 1027 - protein, 29 aa, Artificial Sequence
  Synthetic Construct
YKGANKKGLSKGCFGLKLDRIGSMSGLGC

SEQ ID NO: 1028 - protein, 28 aa, Artificial Sequence
  Synthetic Construct
KGANKKGLSKGCFGLKLDRIGSMSGLGC

SEQ ID NO: 1029 - protein, 27 aa, Artificial Sequence
  Synthetic Construct
GANKKGLSKGCFGLKLDRIGSMSGLGC

SEQ ID NO: 1030 - protein, 26 aa, Artificial Sequence
  Synthetic Construct
ANKKGLSKGCFGLKLDRIGSMSGLGC

SEQ ID NO: 1031 - protein, 25 aa, Artificial Sequence
  Synthetic Construct
NKKGLSKGCFGLKLDRIGSMSGLGC

SEQ ID NO: 1032 - protein, 24 aa, Artificial Sequence
  Synthetic Construct
KKGLSKGCFGLKLDRIGSMSGLGC

SEQ ID NO: 1033 - protein, 23 aa, Artificial Sequence
  Synthetic Construct
KGLSKGCFGLKLDRIGSMSGLGC

SEQ ID NO: 1034 - protein, 21 aa, Artificial Sequence
  Synthetic Construct
LSKGCFGLKLDRIGSMSGLGC

SEQ ID NO: 1035 - protein, 20 aa, Artificial Sequence
  Synthetic Construct
SKGCFGLKLDRIGSMSGLGC

SEQ ID NO: 1036 - protein, 19 aa, Artificial Sequence
  Synthetic Construct
KGCFGLKLDRIGSMSGLGC

SEQ ID NO: 1037 - protein, 18 aa, Artificial Sequence
  Synthetic Construct
GCFGLKLDRIGSMSGLGC

SEQ ID NO: 1038 - protein, 37 aa, Artificial Sequence
  Synthetic Construct
QEHPNARKYKGANKKGLSKGCFGLKLDRIGSNSGLGC

SEQ ID NO: 1039 - protein, 38 aa, Artificial Sequence
  Synthetic Construct
PQEHPNARKYKGANKKGLSKGCFGLKLDRIGSMSGLGC

SEQ ID NO: 1040 - protein, 38 aa, Artificial Sequence
  Synthetic Construct
MQEHPNARKYKGANKKGLSKGCFGLKLDRIGSMSGLGC

SEQ ID NO: 1041 - protein, 38 aa, Artificial Sequence
  Synthetic Construct
GQEHPNARKYKGANKKGLSKGCFGLKLDRIGSMSGLGC

SEQ ID NO: 1042 - protein, 38 aa, Artificial Sequence
  Synthetic Construct
GQEHPNARKYKGANPKGLSKGCFGLKLDRIGSMSGLGC

SEQ ID NO: 1043 - protein, 38 aa, Artificial Sequence
  Synthetic Construct
GQEHPNARKYKGANQKGLSKGCFGLKLDRIGSMSGLGC

SEQ ID NO: 1044 - protein, 38 aa, Artificial Sequence
  Synthetic Construct
GQEHPNARKYKGANQQGLSKGCFGLKLDRIGSMSGLGC

SEQ ID NO: 1045 - protein, 38 aa, Artificial Sequence
  Synthetic Construct
GQEHPNARKYKGANKPGLSKGCFGLKLDRIGSMSGLGC

SEQ ID NO: 1046 - protein, 38 aa, Artificial Sequence
  Synthetic Construct
GQEHPNARKYKGANKKGLSKGCFGLKLDRIGSNSGLGC

SEQ ID NO: 1047 - protein, 39 aa, Artificial Sequence
  Synthetic Construct
PGQEHPNARKYKGANKKGLSKGCFGLKLDRIGSMSGLGC

SEQ ID NO: 1048 - protein, 39 aa, Artificial Sequence
  Synthetic Construct
MGQEHPNARKYKGANKKGLSKGCFGLKLDRIGSMSGLGC

SEQ ID NO: 1049 - protein, 27 aa, Artificial Sequence
  Synthetic Construct
GANRRGLSRGCFGLKLDRIGSMSGLGC

SEQ ID NO: 1050 - protein, 27 aa, Artificial Sequence
  Synthetic Construct
GANRRGLSRGCFGLKLDRIGSNSGLGC

SEQ ID NO: 1051 - protein, 28 aa, Artificial Sequence
  Synthetic Construct
PGANRRGLSRGCFGLKLDRIGSMSGLGC

SEQ ID NO: 1052 - protein, 28 aa, Artificial Sequence
  Synthetic Construct
MGANRRGLSRGCFGLKLDRIGSMSGLGC

SEQ ID NO: 1053 - protein, 38 aa, Artificial Sequence
  Synthetic Construct
GHKSEVAHRFKGANKKGLSKGCFGLKLDRIGSMSGLGC

SEQ ID NO: 1054 - protein, 38 aa, Artificial Sequence
  Synthetic Construct
GHKSEVAHRFKGANKKGLSKGCFGLKLDRIGSNSGLGC

SEQ ID NO: 1055 - protein, 39 aa, Artificial Sequence
  Synthetic Construct
PGHKSEVAHRFKGANKKGLSKGCFGLKLDRIGSMSGLGC

SEQ ID NO: 1056 - protein, 39 aa, Artificial Sequence
  Synthetic Construct
MGHKSEVAHRFKGANKKGLSKGCFGLKLDRIGSMSGLGC

SEQ ID NO: 1057 - protein, 23 aa, Artificial Sequence
  Synthetic Construct
RGLSRGCFGLKLDRIGSMSGLGC

SEQ ID NO: 1058 - protein, 24 aa, Artificial Sequence
  Synthetic Construct
ERGLSRGCFGLKLDRIGSMSGLGC

SEQ ID NO: 1059 - protein, 27 aa, Artificial Sequence
  Synthetic Construct
GANQQGLSKGCFGLKLDRIGSMSGLGC

SEQ ID NO: 1060 - protein, 27 aa, Artificial Sequence
  Synthetic Construct
GANRRGLSKGCFGLKLDRIGSMSGLGC

SEQ ID NO: 1061 - protein, 27 aa, Artificial Sequence
  Synthetic Construct
GANPRGLSKGCFGLKLDRIGSMSGLGC

SEQ ID NO: 1062 - protein, 27 aa, Artificial Sequence
  Synthetic Construct
GANSSGLSKGCFGLKLDRIGSMSGLGC

SEQ ID NO: 1063 - protein, 27 aa, Artificial Sequence
  Synthetic Construct
GANPRGLSRGCFGLKLDRIGSMSGLGC

SEQ ID NO: 1064 - protein, 27 aa, Artificial Sequence
  Synthetic Construct
GANRRGLSRGCFGLKLDRIGSMSGLGC

SEQ ID NO: 1065 - protein, 27 aa, Artificial Sequence
  Synthetic Construct
GANQQGLSRGCFGLKLDRIGSMSGLGC

SEQ ID NO: 1066 - protein, 27 aa, Artificial Sequence
  Synthetic Construct
GANSSGLSRGCFGLKLDRIGSMSGLGC

SEQ ID NO: 1067 - protein, 35 aa, Artificial Sequence
  Synthetic Construct
AAWARLLQEHPNAGLSKGCFGLKLDRIGSMSGLGC

SEQ ID NO: 1068 - protein, 36 aa, Artificial Sequence
  Synthetic Construct
AAWARLLQEHPNARGLSKGCFGLKLDRIGSMSGLGC

SEQ ID NO: 1069 - protein, 36 aa, Artificial Sequence
  Synthetic Construct
DLRVDTKSRAAWARGLSKGCFGLKLDRIGSMSGLGC

SEQ ID NO: 1070 - protein, 38 aa, Artificial Sequence; identical to SEQ ID NO: 1042
  Synthetic Construct

SEQ ID NO: 1071 - protein, 38 aa, Artificial Sequence; identical to SEQ ID NO: 1043
  Synthetic Construct

SEQ ID NO: 1072 - protein, 22 aa, Artificial Sequence
  Synthetic Construct
GLSRGCFGLKLDRIGSMSGLGC

SEQ ID NO: 1073 - protein, 24 aa, Artificial Sequence
  Synthetic Construct
ERGLSKGCFGLKLDRIGSMSGLGC

SEQ ID NO: 1074 - protein, 23 aa, Artificial Sequence
  Synthetic Construct
RGLSKGCFGLKLDRIGSMSGLGC

SEQ ID NO: 1075 - protein, 22 aa, Artificial Sequence
  Synthetic Construct
GLSRGCFGLRLDRIGSMSGLGC

SEQ ID NO: 1076 - protein, 22 aa, Artificial Sequence
  Synthetic Construct
  MISC_FEATURE (7)..(7): Xaa is D-Phe
GLSKGCXGLKLDRIGSMSGLGC

SEQ ID NO: 1077 - protein, 22 aa, Artificial Sequence
  Synthetic Construct
  MISC_FEATURE (7)..(7): Xaa is 3-amino-2-phenylpropionic acid
GLSKGCXGLKLDRIGSMSGLGC

SEQ ID NO: 1078 - protein, 22 aa, Artificial Sequence
  Synthetic Construct
RLSKGCFGLKLDRIGSMSGLGC

SEQ ID NO: 1079 - protein, 22 aa, Artificial Sequence
  Synthetic Construct
ELSKGCFGLKLDRIGSMSGLGC

SEQ ID NO: 1080 - protein, 22 aa, Artificial Sequence
  Synthetic Construct
GLSKRCFGLKLDRIGSMSGLGC

SEQ ID NO: 1081 - protein, 22 aa, Artificial Sequence
  Synthetic Construct
GLSKQCFGLKLDRIGSMSGLGC

SEQ ID NO: 1082 - protein, 22 aa, Artificial Sequence
  Synthetic Construct
GLSKSCFGLKLDRIGSMSGLGC

SEQ ID NO: 1083 - protein, 22 aa, Artificial Sequence
  Synthetic Construct
GLSKGCFGLKLDRISSMSGLGC

SEQ ID NO: 1084 - protein, 22 aa, Artificial Sequence
  Synthetic Construct
GLSKGCFGLKLDRINSMSGLGC

SEQ ID NO: 1085 - protein, 22 aa, Artificial Sequence
  Synthetic Construct
GLSKGCFGLKLDRIRSMSGLGC

SEQ ID NO: 1086 - protein, 22 aa, Artificial Sequence
  Synthetic Construct
  MISC_FEATURE (15)..(15): Xaa is Cit
GLSKGCFGLKLDRIXSMSGLGC

SEQ ID NO: 1087 - protein, 22 aa, Artificial Sequence
  Synthetic Construct
GLSKGCFGLKLDRIGSMSSLGC

SEQ ID NO: 1088 - protein, 22 aa, Artificial Sequence
  Synthetic Construct
GLSKGCFGLKLDRIGSMSRLGC

SEQ ID NO: 1089 - protein, 22 aa, Artificial Sequence
  Synthetic Construct
GLSKGCFGLKLDRIGSMSNLGC

SEQ ID NO: 1090 - protein, 22 aa, Artificial Sequence
  Synthetic Construct
GLSKGCFGLKLDRIGSMSGLSC

SEQ ID NO: 1091 - protein, 22 aa, Artificial Sequence
  Synthetic Construct
GLSKGCFGLKLDRIGSMSGLTC

SEQ ID NO: 1092 - protein, 22 aa, Artificial Sequence
  Synthetic Construct
GLSKGCFGLKLDRIGSMSGLRC

SEQ ID NO: 1093 - protein, 22 aa, Artificial Sequence
  Synthetic Construct
  MISC_FEATURE (6)..(7): [CH2NH] bond between residues 6 and 7
GLSKGCFGLKLDRIGSMSGLGC

SEQ ID NO: 1094 - protein, 22 aa, Artificial Sequence
  Synthetic Construct
  MISC_FEATURE (7)..(7): Xaa is N-Me-Phe
GLSKGCXGLKLDRIGSMSGLGC

SEQ ID NO: 1095 - protein, 22 aa, Artificial Sequence
  Synthetic Construct
  MISC_FEATURE (8)..(8): Xaa is t-Bu-Gly
GLSKGCFXLKLDRIGSMSGLGC

SEQ ID NO: 1096 - protein, 22 aa, Artificial Sequence
  Synthetic Construct
  MISC_FEATURE (7)..(7): Xaa is NHCH2CH(Phe)CO
GLSKGCXGLKLDRIGSMSGLGC

SEQ ID NO: 1097 - protein, 36 aa, Artificial Sequence
  Synthetic Construct
GQPREPQVYTLPPSGLSKGCFGLKLDRIGSMSGLGC

SEQ ID NO: 1098 - protein, 37 aa, Artificial Sequence
  Synthetic Construct
GERAFKAWAVARLSQGLSKGCFGLKLDRIGSMSGLGC

SEQ ID NO: 1099 - protein, 39 aa, Artificial Sequence
  Synthetic Construct
GQHKDDNPNLPRGANPRGLSKGCFGLKLDRIGSMSGLGC

SEQ ID NO: 1100 - protein, 37 aa, Artificial Sequence
  Synthetic Construct
GHHSHEQHPHGANQQGLSKGCFGLKLDRIGSMSGLGC

SEQ ID NO: 1101 - protein, 38 aa, Artificial Sequence
  Synthetic Construct
GAHHPHEHDTHGANQQGLSKGCFGLKLDRIGSMSGLGC

SEQ ID NO: 1102 - protein, 35 aa, Artificial Sequence
  Synthetic Construct
FGIPMDRIGRNPRGLSKGCFGLKLDRIGSMSGLGC

SEQ ID NO: 1103 - protein, 40 aa, Artificial Sequence [sequence omitted]

SEQ ID NO: 1104 - protein, 32 aa, Artificial Sequence
  Synthetic Construct
SPKMVQGSGCFGLKLDRIGSMSGLGCKVLRRH

SEQ ID NO: 1105 - protein, 37 aa, Artificial Sequence
  Synthetic Construct
GQPREPQVYTGANQQGLSRGCFGLKLDRIGSMSGLGC

SEQ ID NO: 1106 - protein, 36 aa, Artificial Sequence
  Synthetic Construct
GVPQVSTSTGANQQGLSRGCFGLKLDRIGSMSGLGC

SEQ ID NO: 1107 - protein, 37 aa, Artificial Sequence
  Synthetic Construct
GQPSSSSQSTGANQQGLSRGCFGLKLDRIGSMSGLGC

SEQ ID NO: 1108 - protein, 37 aa, Artificial Sequence
  Synthetic Construct
GSTGQWHSESGANQQGLSRGCFGLKLDRIGSMSGLGC

SEQ ID NO: 1109 - protein, 37 aa, Artificial Sequence
  Synthetic Construct
GQTHSSGTQSGANQQGLSRGCFGLKLDRIGSMSGLGC

SEQ ID NO: 1110 - protein, 37 aa, Artificial Sequence
  Synthetic Construct
GSSSSSSSSSGANQQGLSRGCFGLKLDRIGSMSGLGC

SEQ ID NO: 1111 - protein, 22 aa, Artificial Sequence
  Synthetic Construct
  MISC_FEATURE (6)..(7): [CH2NH] bond between residues 6 and 7
  MISC_FEATURE (9)..(9): Xaa is N-Me-Leu
  MISC_FEATURE (20)..(20): Xaa is N-Me-Leu
GLSKGCFGXKLDRIGSMSGXGC

SEQ ID NO: 1112 - protein, 22 aa, Artificial Sequence
  Synthetic Construct
  MISC_FEATURE (9)..(9): Xaa is N-Me-Leu
  MISC_FEATURE (20)..(20): Xaa is N-Me-Leu
GLSKGCFGXKLDRIGSMSGXGC

SEQ ID NO: 1113 - protein, 22 aa, Artificial Sequence
  Synthetic Construct
  MISC_FEATURE (9)..(9): Xaa is N-Me-Leu
  MISC_FEATURE (11)..(11): Xaa is N-Me-Leu
  MISC_FEATURE (20)..(20): Xaa is N-Me-Leu
GLSKGCFGXKXDRIGSMSGXGC

SEQ ID NO: 1114 - protein, 22 aa, Artificial Sequence
  Synthetic Construct
  MISC_FEATURE (9)..(9): Xaa is N-Me-Leu
  MISC_FEATURE (11)..(11): Xaa is N-Me-Leu
GLSKGCFGXKXDRIGSMSGLGC

SEQ ID NO: 1115 - protein, 22 aa, Artificial Sequence
  Synthetic Construct
GLSRGCYGLKLDRIGSMSGLGC

SEQ ID NO: 1116 - protein, 22 aa, Artificial Sequence
  Synthetic Construct
GLSRGCFVLKLDRIGSMSGLGC

SEQ ID NO: 1117 - protein, 22 aa, Artificial Sequence
  Synthetic Construct
GLSRGCFSLKLDRIGSMSGLGC

SEQ ID NO: 1118 - protein, 22 aa, Artificial Sequence
  Synthetic Construct
GLSRGCFTLKLDRIGSMSGLGC

SEQ ID NO: 1119 - protein, 22 aa, Artificial Sequence
  Synthetic Construct
GLSRGCFGTKLDRIGSMSGLGC

SEQ ID NO: 1120 - protein, 22 aa, Artificial Sequence
  Synthetic Construct
GLSRGCFGLKLDRIRSMSGLGC

SEQ ID NO: 1121 - protein, 22 aa, Artificial Sequence
  Synthetic Construct
  MISC_FEATURE (15)..(15): Xaa is Cit
GLSRGCFGLKLDRIXSMSGLGC

SEQ ID NO: 1122 - protein, 22 aa, Artificial Sequence
  Synthetic Construct
GLSRGCFGLKLDRIGSVSGLGC

SEQ ID NO: 1123 - protein, 22 aa, Artificial Sequence
  Synthetic Construct
GLSRGCFGLKLDRIGSMSGVGC

SEQ ID NO: 1124 - protein, 22 aa, Artificial Sequence
  Synthetic Construct
  MISC_FEATURE (20)..(20): Xaa is t-Bu-Ala
GLSRGCFGLKLDRIGSMSGXGC

SEQ ID NO: 1125 - protein, 22 aa, Artificial Sequence
  Synthetic Construct
ELSEGCFGLKLDRIGSMSGLGC

SEQ ID NO: 1126 - protein, 22 aa, Artificial Sequence
  Synthetic Construct
  MOD_RES (1)..(1): N-terminus modified with pentanoic acid
ELSEGCFGLKLDRIGSMSGLGC

SEQ ID NO: 1127 - protein, 22 aa, Artificial Sequence
  Synthetic Construct
  MOD_RES (1)..(1): N-terminus modified with heptanoic acid
ELSEGCFGLKLDRIGSMSGLGC

SEQ ID NO: 1128 - protein, 22 aa, Artificial Sequence
  Synthetic Construct
  MOD_RES (1)..(1): N-terminus modified with pentanoic acid
ELSKGCFGLKLDRIGSMSGLGC

SEQ ID NO: 1129 - protein, 22 aa, Artificial Sequence
  Synthetic Construct
  MOD_RES (1)..(1): N-terminus modified with heptanoic acid
ELSKGCFGLKLDRIGSMSGLGC

SEQ ID NO: 1130 - protein, 22 aa, Artificial Sequence
  Synthetic Construct
  MISC_FEATURE (10)..(10): Xaa is Cit
GLSKGCFGLXLDRIGSMSGLGC

SEQ ID NO: 1131 - protein, 22 aa, Artificial Sequence
  Synthetic Construct
GLSKGCFGLQLDRIGSMSGLGC

SEQ ID NO: 1132 - protein, 22 aa, Artificial Sequence
  Synthetic Construct
GLSKGCFGLRLDRIGSMSGLGC

SEQ ID NO: 1133 - protein, 22 aa, Artificial Sequence
  Synthetic Construct
GLSKGCFGLKLDRINSMSGLGC

SEQ ID NO: 1134 - protein, 22 aa, Artificial Sequence
  Synthetic Construct
GLSKGCFGLKLDRISSMSGLGC

SEQ ID NO: 1135 - protein, 22 aa, Artificial Sequence
  Synthetic Construct
  MISC_FEATURE (1)..(22): All D-amino acids
GLSKGCFGLKLDRIGSMSGLGC

SEQ ID NO: 1136 - protein, 22 aa, Artificial Sequence
  Synthetic Construct
  MISC_FEATURE (9)..(9): Xaa is N-Me-Leu
GLSKGCFGXKLDRIGSMSGLGC

SEQ ID NO: 1137 - protein, 22 aa, Artificial Sequence
  Synthetic Construct
  MISC_FEATURE (11)..(11): Xaa is N-Me-Leu
GLSKGCFGLKXDRIGSMSGLGC

SEQ ID NO: 1138 - protein, 22 aa, Artificial Sequence
  Synthetic Construct
  MISC_FEATURE (20)..(20): Xaa is N-Me-Leu
GLSKGCFGLKLDRIGSMSGXGC

SEQ ID NO: 1139 - protein, 22 aa, Artificial Sequence
  Synthetic Construct
  MISC_FEATURE (7)..(7): Xaa is 3,4-dichloro-Phe
GLSGGCXGLKLDRIGSMSGLGC

SEQ ID NO: 1140 - protein, 22 aa, Artificial Sequence
  Synthetic Construct
  MISC_FEATURE (7)..(7): Xaa is 3-Me-Phe
GLSGGCXGLKLDRIGSMSGLGC

SEQ ID NO: 1141 - protein, 22 aa, Artificial Sequence
  Synthetic Construct
GLSRSCFGLKLDRIGSMSGLGC

SEQ ID NO: 1142 - protein, 22 aa, Artificial Sequence
  Synthetic Construct
GLSRRCFGLKLDRIGSMSGLGC

SEQ ID NO: 1143 - protein, 22 aa, Artificial Sequence
  Synthetic Construct
GLSGGCFGLKLDRIGSMSGLGC

SEQ ID NO: 1144 - protein, 22 aa, Artificial Sequence
  Synthetic Construct
GLSGGCFGLSLDRIGSMSGLGC

SEQ ID NO: 1145 - protein, 22 aa, Artificial Sequence
  Synthetic Construct
GLSRGCFGLKLDRIGQMSGLGC

SEQ ID NO: 1146 - protein, 22 aa, Artificial Sequence
  Synthetic Construct
GLSRGCFGLKLDRIGSNSGLGC

SEQ ID NO: 1147 - protein, 22 aa, Artificial Sequence
  Synthetic Construct
GLSRGCFGLKLDRIGSMSSLGC

SEQ ID NO: 1148 - protein, 22 aa, Artificial Sequence
  Synthetic Construct
GLSRGCFGLKLDRIGSMSRLGC

SEQ ID NO: 1149 - protein, 22 aa, Artificial Sequence
  Synthetic Construct
GLSRGCFGLKLDRIGSMSGRGC

SEQ ID NO: 1150 - protein, 22 aa, Artificial Sequence
  Synthetic Construct
GLSRGCFGLKLDRIGSMSGLSC

SEQ ID NO: 1151 - protein, 22 aa, Artificial Sequence
  Synthetic Construct
GLSRGCFGLKLDRIGSMSGLTC

SEQ ID NO: 1152 - protein, 22 aa, Artificial Sequence
  Synthetic Construct
GLSRGCFGLKLDRIGSMSGLRC

SEQ ID NO: 1153 - protein, 22 aa, Artificial Sequence
  Synthetic Construct
  MISC_FEATURE (7)..(7): Xaa is D-Phe
GLSKGCXGLKLDRIGSMSGLGC

SEQ ID NO: 1154 - protein, 22 aa, Artificial Sequence
  Synthetic Construct
  MISC_FEATURE (7)..(7): Xaa is 3-Cl-Phe
GLSKGCXGLKLDRIGSMSGLGC

SEQ ID NO: 1155 - protein, 20 aa, Artificial Sequence
  Synthetic Construct
RSSCFGGRISRIGACFFFFF

SEQ ID NO: 1156-1200 - skipped (45 entries)

SEQ ID NO: 1201 - protein, 743 aa, Artificial Sequence
  Synthetic Construct
MVSPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSLKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKDIDDDDDDDDDD

SEQ ID NO: 1202 - protein, 502 aa, Artificial Sequence
  Synthetic Construct
MVSPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASS

SEQ ID NO: 1203 - skipped

SEQ ID NO: 1204 - protein, 726 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSLKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKDIDDDDDDDDDD

SEQ ID NO: 1205 - protein, 485 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASS

SEQ ID NO: 1206 - protein, 524 aa, Bos taurus
MISPFLLLAIGTCFASSLVPEKEKDPKYWRDQAQQTLKNALRLQTLNTNVAKNVIMFLGDGMGVSTVTAARILKGQLHHSPGEETKLEMDKFPYVALSKTYNTNAQVPDSAGTATAYLCGVKANEGTVGVSAATQRSQCNTTQGNEVTSILRWAKDAGKSVGIVTTTRVNHATPSASYAHSADRDWYSDNEMPPEALSQGCKDIAYQLMYNIKDIEVIMGGGRKYMFPKNRTDVEYELDEKARGTRLDGLNLIDIWKSFKPKHKHSHYVWNRTDLLALDPHSVDYLLGLFEPGDMQYELNRNNATDPSLSEMVEMAIRILNKNPKGFFLLVEGGRIDHGHHEGKAKQALHEAVEMDQAIGQAGAMTSVEDTLTVVTADHSHVFTFGGYTPRGNSIFGLAPMVSDTDKKPFTAILYGNGPGYKVVGGERENVSMVDYAHNNYQAQSAVPLRHETHGGEDVAVFAKGPMAHLLHGVQEQNYIPHVMAYAACIGANRDHCASASSSGSPSPGPLLLLLALLPLGSLF

SEQ ID NO: 1207 - protein, 524 aa, Felis catus
MISPFLVLAIGTCLTNSLVPEKEKDPKYWRDQAQQTLKNALRLQKLNTNVVKNVIMFLGDGMGVSTVTAARILKGQLHHNPGEETRLEMDKFPYVALSKTYNTNAQVPDSAGTATAYLCGVKANEGTVGVSAATQRTQCNTTQGNEVTSILRWAKDSGKSVGIVTTTRVNHATPSAAYAHSADRDWYSDNEMPPEALSQGCKDIAYQLMHNVRDIEVIMGGGRKYMFPKNRTDVEYEMDEKARGTRLDGLNLVDIWKSFKPRHKHSHYVWNRTELLTLDPYGVDYLLGLFEPGDMQYELNRNSTTDPSLSEMVEIAIKILSKNPKGFFLLVEGGRIDHGHHEGKAKQALHEAVEMDQAIGRAGAMTSVEDTLTIVTADHSHVFTFGGYTPRGNSIFGLAPMVSDTDKKPFTSILYGNGPGYKVVGGERENVSMVDYAHNNYQAQSAVPLRHETHGGEDVAVFAKGPMAHLLHGVHEQNYIPHVMAYAACIGANLDHCASASSAGGPSPGPLFLLLALPSLGILF

SEQ ID NO: 1208 - protein, 524 aa, Homo sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 1209 - protein, 524 aa, Mus musculus
MISPFLVLAIGTCLTNSFVPEKERDPSYWRQQAQETLKNALKLQKLNTNVAKNVIMFLGDGMGVSTVTAARILKGQLHHNTGEETRLEMDKFPFVALSKTYNTNAQVPDSAGTATAYLCGVKANEGTVGVSAATERTRCNTTQGNEVTSILRWAKDAGKSVGIVTTTRVNHATPSAAYAHSADRDWYSDNEMPPEALSQGCKDIAYQLMHNIKDIDVIMGGGRKYMYPKNRTDVEYELDEKARGTRLDGLDLISIWKSFKPRHKHSHYVWNRTELLALDPSRVDYLLGLFEPGDMQYELNRNNLTDPSLSEMVEVALRILTKNLKGFFLLVEGGRIDHGHHEGKAKQALHEAVEMDQAIGKAGAMTSQKDTLTVVTADHSHVFTFGGYTPRGNSIFGLAPMVSDTDKKPFTAILYGNGPGYKVVDGERENVSMVDYAHNNYQAQSAVPLRHETHGGEDVAVFAKGPMAHLLHGVHEQNYIPHVMAYASCIGANLDHCAWAGSGSAPSPGALLLPLAVLSLPTLF

SEQ ID NO: 1210 - protein, 524 aa, Rattus norvegicus
MILPFLVLAIGTCLTNSFVPEKEKDPSYWRQQAQETLKNALKLQKLNTNVAKNIIMFLGDGMGVSTVTAARILKGQLHHNTGEETRLEMDKFPFVALSKTYNTNAQVPDSAGTATAYLCGVKANEGTVGVSAATERTRCNTTQGNEVTSILRWAKDAGKSVGIVTTTRVNHATPSAAYAHSADRDWYSDNEMPPEALSQGCKDIAYQLMHNIKDIDVIMGGGRKYMYPKNRTDVEYELDEKARGTRLDGLDLISIWKSFKPRHKHSHYVWNRTELLALDPSRVDYLLGLFEPGDMQYELNRNNLTDPSLSEMVEVALRILTKNPKGFFLLVEGGRIDHGHHEGKAKQALHEAVEMDEAIGKAGTMTSQKDTLTVVTADHSHVFTFGGYTPRGNSIFGLAPMVSDTDKKPFTAILYGNGPGYKVVDGERENVSMVDYAHNNYQAQSAVPLRHETHGGEDVAVFAKGPMAHLLHGVHEQNYIPHVMAYASCIGANLDHCAWASSASSPSPGALLLPLALFPLRTLF

SEQ ID NO: 1211 - protein, 502 aa, Canis familiaris
EKDPKYWRDQAQQTLKYALRLQNLNTNVAKNVIMFLGDGMGVSTVTATRILKGQLHHNPGEETRLEMDKFPYVALSKTYNTNAQVPDSAGTATAYLCGVKANEGTVGVSAATQRTHCNTTQGNEVTSILRWAKDAGKSVGIVTTTRVNHATPSAAYAHSADRDWYSDNEMPPEALSQGCKDIAYQLMHNVKDIEVIMGGGRKYMFPKNRTDVEYEMDEKSTGARLDGLNLIDIWKNFKPRHKHSHYVWNRTELLALDPYTVDYLLGLFDPGDMQYELNRNNVTDPSLSEMVEIAIKILSKKPRGFFLLVEGGRIDHGHHEGKAKQALHEAVEMDRAIGKAGVMTSLEDTLTVVTADHSHVFTFGGYTPRGNSIFGLAPMVSDTDKKPFTAILYGNGPGYKVVGGERENVSMVDYAHNNYQAQSAVPLRHETHGGEDVAVFAKGPMAHLLHGVHEQNYIPHVMAYAACIGANQDHCASASSAGGPSPGPLLLLLALLPVGILF

SEQ ID NO: 1212 - protein, 528 aa, Homo sapiens
MQGPWVLLLLGLRLQLSLGVIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAHPVAASLPLLAGTLLLLGASAAP

SEQ ID NO: 1213 - protein, 532 aa, Homo sapiens
MQGPWVLLLLGLRLQLSLGIIPVEEENPDFWNRQAAEALGAAKKLQPAQTAAKNLIIFLGDGMGVSTVTAARILKGQKKDKLGPETFLAMDRFPYVALSKTYSVDKHVPDSGATATAYLCGVKGNFQTIGLSAAARFNQCNTTRGNEVISVMNRAKKAGKSVGVVTTTRVQHASPAGAYAHTVNRNWYSDADVPASARQEGCQDIATQLISNMDIDVILGGGRKYMFPMGTPDPEYPDDYSQGGTRLDGKNLVQEWLAKHQGARYVWNRTELLQASLDPSVTHLMGLFEPGDMKYEIHRDSTLDPSLMEMTEAALLLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDGETHAGEDVAVFARGPQAHLVHGVQEQTFIAHVMAFAACLEPYTACDLAPRAGTTDAAHPGPSVVPALLPLLAGTLLLLGTATAP

SEQ ID NO: 1214 - protein, 535 aa, Homo sapiens
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 1215 - protein, 541 aa, Artificial Sequence
  Synthetic Construct
  MISC_FEATURE (1)..(27): Xaa can be any naturally occuring amino acid or any amino acid at the corresponding position in one of SEQ ID NOs: 1206-1214
  MISC_FEATURE (29)..(30): Xaa can be any naturally occuring amino acid or any amino acid at the corresponding position in one of SEQ ID NOs: 1206-1214
  MISC_FEATURE (32)..(33): Xaa can be any naturally occuring amino acid or any amino acid at the corresponding position in one of SEQ ID NOs: 1206-1214
  MISC_FEATURE (35)..(37): Xaa can be any naturally occuring amino acid or any amino acid at the corresponding position in one of SEQ ID NOs: 1206-1214
  MISC_FEATURE (39)..(41): Xaa can be any naturally occuring amino acid or any amino acid at the corresponding position in one of SEQ ID NOs: 1206-1214
  MISC_FEATURE (43)..(44): Xaa can be any naturally occuring amino acid or any amino acid at the corresponding position in one of SEQ ID NOs: 1206-1214
  MISC_FEATURE (46)..(47): Xaa can be any naturally occuring amino acid or any amino acid at the corresponding position in one of SEQ ID NOs: 1206-1214
  MISC_FEATURE (50)..(56): Xaa can be any naturally occuring amino acid or any amino acid at the corresponding position in one of SEQ ID NOs: 1206-1214
  MISC_FEATURE (59)..(59): Xaa can be any naturally occuring amino acid or any amino acid at the corresponding position in one of SEQ ID NOs: 1206-1214
  MISC_FEATURE (61)..(61): Xaa can be any naturally occuring amino acid or any amino acid at the corresponding position in one of SEQ ID NOs: 1206-1214
  MISC_FEATURE (67)..(67): Xaa can be any naturally occuring amino acid or any amino acid at the corresponding position in one of SEQ ID NOs: 1206-1214
  MISC_FEATURE (70)..(70): Xaa can be any naturally occuring amino acid or any amino acid at the corresponding position in one of SEQ ID NOs: 1206-1214
  MISC_FEATURE (75)..(75): Xaa can be any naturally occuring amino acid or any amino acid at the corresponding position in one of SEQ ID NOs: 1206-1214
  MISC_FEATURE (82)..(86): Xaa can be any naturally occuring amino acid or any amino acid at the corresponding position in one of SEQ ID NOs: 1206-1214
  MISC_FEATURE (88)..(88): Xaa can be any naturally occuring amino acid or any amino acid at the corresponding position in one of SEQ ID NOs: 1206-1214
  MISC_FEATURE (90)..(91): Xaa can be any naturally occuring amino acid or any amino acid at the corresponding position in one of SEQ ID NOs: 1206-1214
  MISC_FEATURE (93)..(93): Xaa can be any naturally occuring amino acid or any amino acid at the corresponding position in one of SEQ ID NOs: 1206-1214
  MISC_FEATURE (96)..(96): Xaa can be any naturally occuring amino acid or any amino acid at the corresponding position in one of SEQ ID NOs: 1206-1214
  MISC_FEATURE (99)..(100): Xaa can be any naturally occuring amino acid or any amino acid at the corresponding position in one of SEQ ID NOs: 1206-1214
  MISC_FEATURE (107)..(111): Xaa can be any naturally occuring amino acid or any amino acid at the corresponding position in one of SEQ ID NOs: 1206-1214
  MISC_FEATURE (116)..(117): Xaa can be any naturally occuring amino acid or any amino acid at the corresponding position in one of SEQ ID NOs: 1206-1214
  MISC_FEATURE (128)..(128): Xaa can be any naturally occuring amino acid or any amino acid at the corresponding position in one of SEQ ID NOs: 1206-1214
  MISC_FEATURE (130)..(131): Xaa can be any naturally occuring amino acid or any amino acid at the corresponding position in one of SEQ ID NOs: 1206-1214
  MISC_FEATURE (133)..(133): Xaa can be any naturally occuring amino acid or any amino acid at the corresponding position in one of SEQ ID NOs: 1206-1214
  MISC_FEATURE (135)..(135): Xaa can be any naturally occuring amino acid or any amino acid at the corresponding position in one of SEQ ID NOs: 1206-1214
  MISC_FEATURE (139)..(143): Xaa can be any naturally occuring amino acid or any amino acid at the corresponding position in one of SEQ ID NOs: 1206-1214
  MISC_FEATURE (148)..(148): Xaa can be any naturally occuring amino acid or any amino acid at the corresponding position in one of SEQ ID NOs: 1206-1214
  MISC_FEATURE (153)..(153): Xaa can be any naturally occuring amino acid or any amino acid at the corresponding position in one of SEQ ID NOs: 1206-1214
  MISC_FEATURE (155)..(158): Xaa can be any naturally occuring amino acid or any amino acid at the corresponding position in one of SEQ ID NOs: 1206-1214
  MISC_FEATURE (161)..(162): Xaa can be any naturally occuring amino acid or any amino acid at the corresponding position in one of SEQ ID NOs: 1206-1214
  MISC_FEATURE (168)..(168): Xaa can be any naturally occuring amino acid or any amino acid at the corresponding position in one of SEQ ID NOs: 1206-1214
  MISC_FEATURE (175)..(175): Xaa can be any naturally occuring amino acid or any amino acid at the corresponding position in one of SEQ ID NOs: 1206-1214
  MISC_FEATURE (178)..(178): Xaa can be any naturally occuring amino acid or any amino acid at the corresponding position in one of SEQ ID NOs: 1206-1214
  MISC_FEATURE (180)..(182): Xaa can be any naturally occuring amino acid or any amino acid at the corresponding position in one of SEQ ID NOs: 1206-1214
  MISC_FEATURE (186)..(188): Xaa can be any naturally occuring amino acid or any amino acid at the corresponding position in one of SEQ ID NOs: 1206-1214
  MISC_FEATURE (190)..(190): Xaa can be any naturally occuring amino acid or any amino acid at the corresponding position in one of SEQ ID NOs: 1206-1214
  MISC_FEATURE (195)..(197): Xaa can be any naturally occuring amino acid or any amino acid at the corresponding position in one of SEQ ID NOs: 1206-1214
  MISC_FEATURE (199)..(200): Xaa can be any naturally occuring amino acid or any amino acid at the corresponding position in one of SEQ ID NOs: 1206-1214
  MISC_FEATURE (202)..(204): Xaa can be any naturally occuring amino acid or any amino acid at the corresponding position in one of SEQ ID NOs: 1206-1214
  MISC_FEATURE (207)..(207): Xaa can be any naturally occuring amino acid or any amino acid at the corresponding position in one of SEQ ID NOs: 1206-1214
  MISC_FEATURE (211)..(211): Xaa can be any naturally occuring amino acid or any amino acid at the corresponding position in one of SEQ ID NOs: 1206-1214
  MISC_FEATURE (214)..(215): Xaa can be any naturally occuring amino acid or any amino acid at the corresponding position in one of SEQ ID NOs: 1206-1214
  MISC_FEATURE (217)..(218): Xaa can be any naturally occuring amino acid or any amino acid at the corresponding position in one of SEQ ID NOs: 1206-1214
  MISC_FEATURE (221)..(221): Xaa can be any naturally occuring amino acid or any amino acid at the corresponding position in one of SEQ ID NOs: 1206-1214
  MISC_FEATURE (224)..(224): Xaa can be any naturally occuring amino acid or any amino acid at the corresponding position in one of SEQ ID NOs: 1206-1214
  MISC_FEATURE (232)..(237): Xaa can be any naturally occuring amino acid or any amino acid at the corresponding position in one of SEQ ID NOs: 1206-1214
  MISC_FEATURE (239)..(239): Xaa can be any naturally occuring amino acid or any amino acid at the corresponding position in one of SEQ ID NOs: 1206-1214
  MISC_FEATURE (242)..(243): Xaa can be any naturally occuring amino acid or any amino acid at the corresponding position in one of SEQ ID NOs: 1206-1214
  MISC_FEATURE (245)..(248): Xaa can be any naturally occuring amino acid or any amino acid at the corresponding position in one of SEQ ID NOs: 1206-1214
  MISC_FEATURE (250)..(250): Xaa can be any naturally occuring amino acid or any amino acid at the corresponding position in one of SEQ ID NOs: 1206-1214
  MISC_FEATURE (255)..(256): Xaa can be any naturally occuring amino acid or any amino acid at the corresponding position in one of SEQ ID NOs: 1206-1214
  MISC_FEATURE (258)..(260): Xaa can be any naturally occuring amino acid or any amino acid at the corresponding position in one of SEQ ID NOs: 1206-1214
  MISC_FEATURE (262)..(274): Xaa can be any naturally occuring amino acid or any amino acid at the corresponding position in one of SEQ ID NOs: 1206-1214
  MISC_FEATURE (279)..(279): Xaa can be any naturally occuring amino acid or any amino acid at the corresponding position in one of SEQ ID NOs: 1206-1214
  MISC_FEATURE (281)..(288): Xaa can be any naturally occuring amino acid or any amino acid at the corresponding position in one of SEQ ID NOs: 1206-1214
  MISC_FEATURE (290)..(291): Xaa can be any naturally occuring amino acid or any amino acid at the corresponding position in one of SEQ ID NOs: 1206-1214
  MISC_FEATURE (293)..(293): Xaa can be any naturally occuring amino acid or any amino acid at the corresponding position in one of SEQ ID NOs: 1206-1214
  MISC_FEATURE (297)..(297): Xaa can be any naturally occuring amino acid or any amino acid at the corresponding position in one of SEQ ID NOs: 1206-1214
  MISC_FEATURE (301)..(302): Xaa can be any naturally occuring amino acid or any amino acid at the corresponding position in one of SEQ ID NOs: 1206-1214
  MISC_FEATURE (305)..(306): Xaa can be any naturally occuring amino acid or any amino acid at the corresponding position in one of SEQ ID NOs: 1206-1214
  MISC_FEATURE (308)..(311): Xaa can be any naturally occuring amino acid or any amino acid at the corresponding position in one of SEQ ID NOs: 1206-1214
  MISC_FEATURE (316)..(316): Xaa can be any naturally occuring amino acid or any amino acid at the corresponding position in one of SEQ ID NOs: 1206-1214
  MISC_FEATURE (319)..(321): Xaa can be any naturally occuring amino acid or any amino acid at the corresponding position in one of SEQ ID NOs: 1206-1214
  MISC_FEATURE (323)..(325): Xaa can be any naturally occuring amino acid or any amino acid at the corresponding position in one of SEQ ID NOs: 1206-1214
  MISC_FEATURE (327)..(331): Xaa can be any naturally occuring amino acid or any amino acid at the corresponding position in one of SEQ ID NOs: 1206-1214
  MISC_FEATURE (334)..(334): Xaa can be any naturally occuring amino acid or any amino acid at the corresponding position in one of SEQ ID NOs: 1206-1214
  MISC_FEATURE (336)..(336): Xaa can be any naturally occuring amino acid or any amino acid at the corresponding position in one of SEQ ID NOs: 1206-1214
  MISC_FEATURE (349)..(350): Xaa can be any naturally occuring amino acid or any amino acid at the corresponding position in one of SEQ ID NOs: 1206-1214
  MISC_FEATURE (352)..(353): Xaa can be any naturally occuring amino acid or any amino acid at the corresponding position in one of SEQ ID NOs: 1206-1214
  MISC_FEATURE (356)..(356): Xaa can be any naturally occuring amino acid or any amino acid at the corresponding position in one of SEQ ID NOs: 1206-1214
  MISC_FEATURE (358)..(361): Xaa can be any naturally occuring amino acid or any amino acid at the corresponding position in one of SEQ ID NOs: 1206-1214
  MISC_FEATURE (363)..(363): Xaa can be any naturally occuring amino acid or any amino acid at the corresponding position in one of SEQ ID NOs: 1206-1214
  MISC_FEATURE (366)..(367): Xaa can be any naturally occuring amino acid or any amino acid at the corresponding position in one of SEQ ID NOs: 1206-1214
  MISC_FEATURE (370)..(371): Xaa can be any naturally occuring amino acid or any amino acid at the corresponding position in one of SEQ ID NOs: 1206-1214
  MISC_FEATURE (374)..(375): Xaa can be any naturally occuring amino acid or any amino acid at the corresponding position in one of SEQ ID NOs: 1206-1214
  MISC_FEATURE (379)..(380): Xaa can be any naturally occuring amino acid or any amino acid at the corresponding position in one of SEQ ID NOs: 1206-1214
  MISC_FEATURE (390)..(390): Xaa can be any naturally occuring amino acid or any amino acid at the corresponding position in one of SEQ ID NOs: 1206-1214
  MISC_FEATURE (395)..(396): Xaa can be any naturally occuring amino acid or any amino acid at the corresponding position in one of SEQ ID NOs: 1206-1214
  MISC_FEATURE (399)..(399): Xaa can be any naturally occuring amino acid or any amino acid at the corresponding position in one of SEQ ID NOs: 1206-1214
  MISC_FEATURE (407)..(411): Xaa can be any naturally occuring amino acid or any amino acid at the corresponding position in one of SEQ ID NOs: 1206-1214
  MISC_FEATURE (413)..(413): Xaa can be any naturally occuring amino acid or any amino acid at the corresponding position in one of SEQ ID NOs: 1206-1214
  MISC_FEATURE (415)..(416): Xaa can be any naturally occuring amino acid or any amino acid at the corresponding position in one of SEQ ID NOs: 1206-1214
  MISC_FEATURE (418)..(419): Xaa can be any naturally occuring amino acid or any amino acid at the corresponding position in one of SEQ ID NOs: 1206-1214
  MISC_FEATURE (428)..(431): Xaa can be any naturally occuring amino acid or any amino acid at the corresponding position in one of SEQ ID NOs: 1206-1214
  MISC_FEATURE (433)..(433): Xaa can be any naturally occuring amino acid or any amino acid at the corresponding position in one of SEQ ID NOs: 1206-1214
  MISC_FEATURE (435)..(436): Xaa can be any naturally occuring amino acid or any amino acid at the corresponding position in one of SEQ ID NOs: 1206-1214
  MISC_FEATURE (438)..(446): Xaa can be any naturally occuring amino acid or any amino acid at the corresponding position in one of SEQ ID NOs: 1206-1214
  MISC_FEATURE (448)..(449): Xaa can be any naturally occuring amino acid or any amino acid at the corresponding position in one of SEQ ID NOs: 1206-1214
  MISC_FEATURE (451)..(451): Xaa can be any naturally occuring amino acid or any amino acid at the corresponding position in one of SEQ ID NOs: 1206-1214
  MISC_FEATURE (456)..(457): Xaa can be any naturally occuring amino acid or any amino acid at the corresponding position in one of SEQ ID NOs: 1206-1214
  MISC_FEATURE (461)..(461): Xaa can be any naturally occuring amino acid or any amino acid at the corresponding position in one of SEQ ID NOs: 1206-1214
  MISC_FEATURE (469)..(470): Xaa can be any naturally occuring amino acid or any amino acid at the corresponding position in one of SEQ ID NOs: 1206-1214
  MISC_FEATURE (473)..(473): Xaa can be any naturally occuring amino acid or any amino acid at the corresponding position in one of SEQ ID NOs: 1206-1214
  MISC_FEATURE (477)..(477): Xaa can be any naturally occuring amino acid or any amino acid at the corresponding position in one of SEQ ID NOs: 1206-1214
  MISC_FEATURE (481)..(481): Xaa can be any naturally occuring amino acid or any amino acid at the corresponding position in one of SEQ ID NOs: 1206-1214
  MISC_FEATURE (484)..(487): Xaa can be any naturally occuring amino acid or any amino acid at the corresponding position in one of SEQ ID NOs: 1206-1214
  MISC_FEATURE (492)..(492): Xaa can be any naturally occuring amino acid or any amino acid at the corresponding position in one of SEQ ID NOs: 1206-1214
  MISC_FEATURE (494)..(494): Xaa can be any naturally occuring amino acid or any amino acid at the corresponding position in one of SEQ ID NOs: 1206-1214
  MISC_FEATURE (496)..(507): Xaa can be any naturally occuring amino acid or any amino acid at the corresponding position in one of SEQ ID NOs: 1206-1214
  MISC_FEATURE (509)..(524): Xaa can be any naturally occuring amino acid or any amino acid at the corresponding position in one of SEQ ID NOs: 1206-1214
  MISC_FEATURE (526)..(532): Xaa can be any naturally occuring amino acid or any amino acid at the corresponding position in one of SEQ ID NOs: 1206-1214
  MISC_FEATURE (534)..(535): Xaa can be any naturally occuring amino acid or any amino acid at the corresponding position in one of SEQ ID NOs: 1206-1214
  MISC_FEATURE (535)..(541): Xaa can be any naturally occuring amino acid
XXXXXXXXXXXXXXXXXXXXXXXXXXXEXXPXXWXXXAXXXLXXAXXLQXXXXXXXKNXIXFLGDGXGVXTVTAXRILKGQXXXXXGXEXXLXMDXFPXXALSKTYXXXXXVPDSXXTATAYLCGVKXNXXTXGXSAAXXXXXCNTTXGNEVXSXXXXAKXXGKSVGXVTTTRVXHAXPXXXYAHXXXRXWYSDXXXPXXAXXXGCXDIAXQLXXNXXDIXVIXGGGRKYMXXXXXXDXEYXXDXXXXGXRLDGXXLXXXWXXXXXXXXXXXXXWNRTXLXXXXXXXXVXXLXGLFXPGDXXYEXXRXXXXDPSLXEMXXXAXXXLXXXXXGFXLXVEGGRIDHGHHEXXAXXALXEXXXXDXAIXXAGXXTSXXDTLXXVTADHSHVFXFGGYXXRGXSIFGLAPXXXXXDXKXXTXXLYGNGPGYXXXXGXRXXVXXXXXXXXXYXXQXAVPLXXETHXGEDVAVFXXGPXAHLXHGVXEQXXXXHVMAXAXCXXXXXXXXXXXXAXXXXXXXXXXXXXXXXLXXXXXXXLXXXXXXXX

SEQ ID NO: 1216 - protein, 524 aa, Artificial Sequence
  Synthetic Construct
  MISC_FEATURE (1)..(22): Xaa can be any naturally occuring amino acid or any amino acid at the corresponding position in one of SEQ ID NOs: 1206-1211
  MISC_FEATURE (24)..(24): Xaa can be any naturally occuring amino acid or any amino acid at the corresponding position in one of SEQ ID NOs: 1206-1211
  MISC_FEATURE (27)..(27): Xaa can be any naturally occuring amino acid or any amino acid at the corresponding position in one of SEQ ID NOs: 1206-1211
  MISC_FEATURE (31)..(31): Xaa can be any naturally occuring amino acid or any amino acid at the corresponding position in one of SEQ ID NOs: 1206-1211
  MISC_FEATURE (35)..(35): Xaa can be any naturally occuring amino acid or any amino acid at the corresponding position in one of SEQ ID NOs: 1206-1211
  MISC_FEATURE (39)..(39): Xaa can be any naturally occuring amino acid or any amino acid at the corresponding position in one of SEQ ID NOs: 1206-1211
  MISC_FEATURE (42)..(42): Xaa can be any naturally occuring amino acid or any amino acid at the corresponding position in one of SEQ ID NOs: 1206-1211
  MISC_FEATURE (45)..(45): Xaa can be any naturally occuring amino acid or any amino acid at the corresponding position in one of SEQ ID NOs: 1206-1211
  MISC_FEATURE (51)..(51): Xaa can be any naturally occuring amino acid or any amino acid at the corresponding position in one of SEQ ID NOs: 1206-1211
  MISC_FEATURE (54)..(54): Xaa can be any naturally occuring amino acid or any amino acid at the corresponding position in one of SEQ ID NOs: 1206-1211
  MISC_FEATURE (70)..(70): Xaa can be any naturally occuring amino acid or any amino acid at the corresponding position in one of SEQ ID NOs: 1206-1211
  MISC_FEATURE (80)..(81): Xaa can be any naturally occuring amino acid or any amino acid at the corresponding position in one of SEQ ID NOs: 1206-1211
  MISC_FEATURE (86)..(86): Xaa can be any naturally occuring amino acid or any amino acid at the corresponding position in one of SEQ ID NOs: 1206-1211
  MISC_FEATURE (94)..(94): Xaa can be any naturally occuring amino acid or any amino acid at the corresponding position in one of SEQ ID NOs: 1206-1211
  MISC_FEATURE (135)..(135): Xaa can be any naturally occuring amino acid or any amino acid at the corresponding position in one of SEQ ID NOs: 1206-1211
  MISC_FEATURE (137)..(138): Xaa can be any naturally occuring amino acid or any amino acid at the corresponding position in one of SEQ ID NOs: 1206-1211
  MISC_FEATURE (157)..(157): Xaa can be any naturally occuring amino acid or any amino acid at the corresponding position in one of SEQ ID NOs: 1206-1211
  MISC_FEATURE (177)..(177): Xaa can be any naturally occuring amino acid or any amino acid at the corresponding position in one of SEQ ID NOs: 1206-1211
  MISC_FEATURE (210)..(210): Xaa can be any naturally occuring amino acid or any amino acid at the corresponding position in one of SEQ ID NOs: 1206-1211
  MISC_FEATURE (212)..(213): Xaa can be any naturally occuring amino acid or any amino acid at the corresponding position in one of SEQ ID NOs: 1206-1211
  MISC_FEATURE (216)..(216): Xaa can be any naturally occuring amino acid or any amino acid at the corresponding position in one of SEQ ID NOs: 1206-1211
  MISC_FEATURE (227)..(227): Xaa can be any naturally occuring amino acid or any amino acid at the corresponding position in one of SEQ ID NOs: 1206-1211
  MISC_FEATURE (231)..(231): Xaa can be any naturally occuring amino acid or any amino acid at the corresponding position in one of SEQ ID NOs: 1206-1211
  MISC_FEATURE (238)..(238): Xaa can be any naturally occuring amino acid or any amino acid at the corresponding position in one of SEQ ID NOs: 1206-1211
  MISC_FEATURE (242)..(243): Xaa can be any naturally occuring amino acid or any amino acid at the corresponding position in one of SEQ ID NOs: 1206-1211
  MISC_FEATURE (245)..(245): Xaa can be any naturally occuring amino acid or any amino acid at the corresponding position in one of SEQ ID NOs: 1206-1211
  MISC_FEATURE (251)..(251): Xaa can be any naturally occuring amino acid or any amino acid at the corresponding position in one of SEQ ID NOs: 1206-1211
  MISC_FEATURE (253)..(255): Xaa can be any naturally occuring amino acid or any amino acid at the corresponding position in one of SEQ ID NOs: 1206-1211
  MISC_FEATURE (258)..(258): Xaa can be any naturally occuring amino acid or any amino acid at the corresponding position in one of SEQ ID NOs: 1206-1211
  MISC_FEATURE (262)..(263): Xaa can be any naturally occuring amino acid or any amino acid at the corresponding position in one of SEQ ID NOs: 1206-1211
  MISC_FEATURE (268)..(269): Xaa can be any naturally occuring amino acid or any amino acid at the corresponding position in one of SEQ ID NOs: 1206-1211
  MISC_FEATURE (274)..(274): Xaa can be any naturally occuring amino acid or any amino acid at the corresponding position in one of SEQ ID NOs: 1206-1211
  MISC_FEATURE (277)..(277): Xaa can be any naturally occuring amino acid or any amino acid at the corresponding position in one of SEQ ID NOs: 1206-1211
  MISC_FEATURE (281)..(282): Xaa can be any naturally occuring amino acid or any amino acid at the corresponding position in one of SEQ ID NOs: 1206-1211
  MISC_FEATURE (291)..(291): Xaa can be any naturally occuring amino acid or any amino acid at the corresponding position in one of SEQ ID NOs: 1206-1211
  MISC_FEATURE (303)..(304): Xaa can be any naturally occuring amino acid or any amino acid at the corresponding position in one of SEQ ID NOs: 1206-1211
  MISC_FEATURE (314)..(315): Xaa can be any naturally occuring amino acid or any amino acid at the corresponding position in one of SEQ ID NOs: 1206-1211
  MISC_FEATURE (317)..(318): Xaa can be any naturally occuring amino acid or any amino acid at the corresponding position in one of SEQ ID NOs: 1206-1211
  MISC_FEATURE (321)..(321): Xaa can be any naturally occuring amino acid or any amino acid at the corresponding position in one of SEQ ID NOs: 1206-1211
  MISC_FEATURE (323)..(325): Xaa can be any naturally occuring amino acid or any amino acid at the corresponding position in one of SEQ ID NOs: 1206-1211
  MISC_FEATURE (357)..(357): Xaa can be any naturally occuring amino acid or any amino acid at the corresponding position in one of SEQ ID NOs: 1206-1211
  MISC_FEATURE (361)..(361): Xaa can be any naturally occuring amino acid or any amino acid at the corresponding position in one of SEQ ID NOs: 1206-1211
  MISC_FEATURE (364)..(365): Xaa can be any naturally occuring amino acid or any amino acid at the corresponding position in one of SEQ ID NOs: 1206-1211
  MISC_FEATURE (368)..(369): Xaa can be any naturally occuring amino acid or any amino acid at the corresponding position in one of SEQ ID NOs: 1206-1211
  MISC_FEATURE (374)..(374): Xaa can be any naturally occuring amino acid or any amino acid at the corresponding position in one of SEQ ID NOs: 1206-1211
  MISC_FEATURE (402)..(402): Xaa can be any naturally occuring amino acid or any amino acid at the corresponding position in one of SEQ ID NOs: 1206-1211
  MISC_FEATURE (412)..(412): Xaa can be any naturally occuring amino acid or any amino acid at the corresponding position in one of SEQ ID NOs: 1206-1211
  MISC_FEATURE (425)..(425): Xaa can be any naturally occuring amino acid or any amino acid at the corresponding position in one of SEQ ID NOs: 1206-1211
  MISC_FEATURE (463)..(463): Xaa can be any naturally occuring amino acid or any amino acid at the corresponding position in one of SEQ ID NOs: 1206-1211
  MISC_FEATURE (475)..(475): Xaa can be any naturally occuring amino acid or any amino acid at the corresponding position in one of SEQ ID NOs: 1206-1211
  MISC_FEATURE (480)..(480): Xaa can be any naturally occuring amino acid or any amino acid at the corresponding position in one of SEQ ID NOs: 1206-1211
  MISC_FEATURE (488)..(488): Xaa can be any naturally occuring amino acid or any amino acid at the corresponding position in one of SEQ ID NOs: 1206-1211
  MISC_FEATURE (494)..(495): Xaa can be any naturally occuring amino acid or any amino acid at the corresponding position in one of SEQ ID NOs: 1206-1211
  MISC_FEATURE (499)..(499): Xaa can be any naturally occuring amino acid or any amino acid at the corresponding position in one of SEQ ID NOs: 1206-1211
  MISC_FEATURE (501)..(502): Xaa can be any naturally occuring amino acid or any amino acid at the corresponding position in one of SEQ ID NOs: 1206-1211
  MISC_FEATURE (502)..(524): Xaa can be any naturally occuring amino acid
XXXXXXXXXXXXXXXXXXXXXXEXDPXYWRXQAQXTLKXALXLQXLNTNVXKNXIMFLGDGMGVSTVTAXRILKGQLHHXXGEETXLEMDKFPXVALSKTYNTNAQVPDSAGTATAYLCGVKANEGTVGVSAATXRXXCNTTQGNEVTSILRWAKDXGKSVGIVTTTRVNHATPSAXYAHSADRDWYSDNEMPPEALSQGCKDIAYQLMXNXXDIXVIMGGGRKYMXPKNXTDVEYEXDEKXXGXRLDGLXLXXXWKXFKPXXKHSHXXWNRTXLLXLDPXXVDYLLGLFXPGDMQYELNRNXXTDPSLSEMVXXAXXILXKXXXGFFLLVEGGRIDHGHHEGKAKQALHEAVEMDXAIGXAGXXTSXXDTLTXVTADHSHVFTFGGYTPRGNSIFGLAPMXSDTDKKPFTXILYGNGPGYKVVXGERENVSMVDYAHNNYQAQSAVPLRHETHGGEDVAVFXKGPMAHLLHGVXEQNYXPHVMAYAXCIGANXXHCAXAXSXXXXXXGXLXLXLAXXXXXXLF

SEQ ID NO: 1217 - DNA, 2232 bp, Artificial Sequence
  Synthetic Construct
atggtttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcgcttaaggacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaagatatcgatgacgatgacgatgacgatgacgatgactag

SEQ ID NO: 1218 - protein, 541 aa, Artificial Sequence
  Synthetic Construct
  MISC_FEATURE (1)..(27): Xaa can be any naturally occurring amino acid but not an amino acid corresponding to one or more pathogenic mutations provided in Table 1 on pages 65-74 of the specification
  MISC_FEATURE (29)..(30): Xaa can be any naturally occurring amino acid but not an amino acid corresponding to one or more pathogenic mutations provided in Table 1 on pages 65-74 of the specification
  MISC_FEATURE (32)..(33): Xaa can be any naturally occurring amino acid but not an amino acid corresponding to one or more pathogenic mutations provided in Table 1 on pages 65-74 of the specification
  MISC_FEATURE (35)..(37): Xaa can be any naturally occurring amino acid but not an amino acid corresponding to one or more pathogenic mutations provided in Table 1 on pages 65-74 of the specification
  MISC_FEATURE (39)..(41): Xaa can be any naturally occurring amino acid but not an amino acid corresponding to one or more pathogenic mutations provided in Table 1 on pages 65-74 of the specification
  MISC_FEATURE (43)..(44): Xaa can be any naturally occurring amino acid but not an amino acid corresponding to one or more pathogenic mutations provided in Table 1 on pages 65-74 of the specification
  MISC_FEATURE (46)..(47): Xaa can be any naturally occurring amino acid but not an amino acid corresponding to one or more pathogenic mutations provided in Table 1 on pages 65-74 of the specification
  MISC_FEATURE (50)..(55): Xaa can be any naturally occurring amino acid but not an amino acid corresponding to one or more pathogenic mutations provided in Table 1 on pages 65-74 of the specification
  MISC_FEATURE (59)..(59): Xaa can be any naturally occurring amino acid but not an amino acid corresponding to one or more pathogenic mutations provided in Table 1 on pages 65-74 of the specification
  MISC_FEATURE (61)..(61): Xaa can be any naturally occurring amino acid but not an amino acid corresponding to one or more pathogenic mutations provided in Table 1 on pages 65-74 of the specification
  MISC_FEATURE (70)..(70): Xaa can be any naturally occurring amino acid but not an amino acid corresponding to one or more pathogenic mutations provided in Table 1 on pages 65-74 of the specification
  MISC_FEATURE (75)..(75): Xaa can be any naturally occurring amino acid but not an amino acid corresponding to one or more pathogenic mutations provided in Table 1 on pages 65-74 of the specification
  MISC_FEATURE (82)..(86): Xaa can be any naturally occurring amino acid but not an amino acid corresponding to one or more pathogenic mutations provided in Table 1 on pages 65-74 of the specification
  MISC_FEATURE (88)..(88): Xaa can be any naturally occurring amino acid but not an amino acid corresponding to one or more pathogenic mutations provided in Table 1 on pages 65-74 of the specification
  MISC_FEATURE (90)..(91): Xaa can be any naturally occurring amino acid but not an amino acid corresponding to one or more pathogenic mutations provided in Table 1 on pages 65-74 of the specification
  MISC_FEATURE (93)..(93): Xaa can be any naturally occurring amino acid but not an amino acid corresponding to one or more pathogenic mutations provided in Table 1 on pages 65-74 of the specification
  MISC_FEATURE (96)..(96): Xaa can be any naturally occurring amino acid but not an amino acid corresponding to one or more pathogenic mutations provided in Table 1 on pages 65-74 of the specification
  MISC_FEATURE (99)..(100): Xaa can be any naturally occurring amino acid but not an amino acid corresponding to one or more pathogenic mutations provided in Table 1 on pages 65-74 of the specification
  MISC_FEATURE (107)..(111): Xaa can be any naturally occurring amino acid but not an amino acid corresponding to one or more pathogenic mutations provided in Table 1 on pages 65-74 of the specification
  MISC_FEATURE (116)..(117): Xaa can be any naturally occurring amino acid but not an amino acid corresponding to one or more pathogenic mutations provided in Table 1 on pages 65-74 of the specification
  MISC_FEATURE (128)..(128): Xaa can be any naturally occurring amino acid but not an amino acid corresponding to one or more pathogenic mutations provided in Table 1 on pages 65-74 of the specification
  MISC_FEATURE (130)..(131): Xaa can be any naturally occurring amino acid but not an amino acid corresponding to one or more pathogenic mutations provided in Table 1 on pages 65-74 of the specification
  MISC_FEATURE (133)..(133): Xaa can be any naturally occurring amino acid but not an amino acid corresponding to one or more pathogenic mutations provided in Table 1 on pages 65-74 of the specification
  MISC_FEATURE (135)..(135): Xaa can be any naturally occurring amino acid but not an amino acid corresponding to one or more pathogenic mutations provided in Table 1 on pages 65-74 of the specification
  MISC_FEATURE (139)..(143): Xaa can be any naturally occurring amino acid but not an amino acid corresponding to one or more pathogenic mutations provided in Table 1 on pages 65-74 of the specification
  MISC_FEATURE (148)..(148): Xaa can be any naturally occurring amino acid but not an amino acid corresponding to one or more pathogenic mutations provided in Table 1 on pages 65-74 of the specification
  MISC_FEATURE (155)..(158): Xaa can be any naturally occurring amino acid but not an amino acid corresponding to one or more pathogenic mutations provided in Table 1 on pages 65-74 of the specification
  MISC_FEATURE (161)..(162): Xaa can be any naturally occurring amino acid but not an amino acid corresponding to one or more pathogenic mutations provided in Table 1 on pages 65-74 of the specification
  MISC_FEATURE (168)..(168): Xaa can be any naturally occurring amino acid but not an amino acid corresponding to one or more pathogenic mutations provided in Table 1 on pages 65-74 of the specification
  MISC_FEATURE (175)..(175): Xaa can be any naturally occurring amino acid but not an amino acid corresponding to one or more pathogenic mutations provided in Table 1 on pages 65-74 of the specification
  MISC_FEATURE (178)..(178): Xaa can be any naturally occurring amino acid but not an amino acid corresponding to one or more pathogenic mutations provided in Table 1 on pages 65-74 of the specification
  MISC_FEATURE (180)..(182): Xaa can be any naturally occurring amino acid but not an amino acid corresponding to one or more pathogenic mutations provided in Table 1 on pages 65-74 of the specification
  MISC_FEATURE (186)..(188): Xaa can be any naturally occurring amino acid but not an amino acid corresponding to one or more pathogenic mutations provided in Table 1 on pages 65-74 of the specification
  MISC_FEATURE (190)..(190): Xaa can be any naturally occurring amino acid but not an amino acid corresponding to one or more pathogenic mutations provided in Table 1 on pages 65-74 of the specification
  MISC_FEATURE (195)..(197): Xaa can be any naturally occurring amino acid but not an amino acid corresponding to one or more pathogenic mutations provided in Table 1 on pages 65-74 of the specification
  MISC_FEATURE (199)..(200): Xaa can be any naturally occurring amino acid but not an amino acid corresponding to one or more pathogenic mutations provided in Table 1 on pages 65-74 of the specification
  MISC_FEATURE (202)..(204): Xaa can be any naturally occurring amino acid but not an amino acid corresponding to one or more pathogenic mutations provided in Table 1 on pages 65-74 of the specification
  MISC_FEATURE (207)..(207): Xaa can be any naturally occurring amino acid but not an amino acid corresponding to one or more pathogenic mutations provided in Table 1 on pages 65-74 of the specification
  MISC_FEATURE (211)..(211): Xaa can be any naturally occurring amino acid but not an amino acid corresponding to one or more pathogenic mutations provided in Table 1 on pages 65-74 of the specification
  MISC_FEATURE (214)..(215): Xaa can be any naturally occurring amino acid but not an amino acid corresponding to one or more pathogenic mutations provided in Table 1 on pages 65-74 of the specification
  MISC_FEATURE (217)..(218): Xaa can be any naturally occurring amino acid but not an amino acid corresponding to one or more pathogenic mutations provided in Table 1 on pages 65-74 of the specification
  MISC_FEATURE (221)..(221): Xaa can be any naturally occurring amino acid but not an amino acid corresponding to one or more pathogenic mutations provided in Table 1 on pages 65-74 of the specification
  MISC_FEATURE (224)..(224): Xaa can be any naturally occurring amino acid but not an amino acid corresponding to one or more pathogenic mutations provided in Table 1 on pages 65-74 of the specification
  MISC_FEATURE (232)..(237): Xaa can be any naturally occurring amino acid but not an amino acid corresponding to one or more pathogenic mutations provided in Table 1 on pages 65-74 of the specification
  MISC_FEATURE (239)..(239): Xaa can be any naturally occurring amino acid but not an amino acid corresponding to one or more pathogenic mutations provided in Table 1 on pages 65-74 of the specification
  MISC_FEATURE (242)..(243): Xaa can be any naturally occurring amino acid but not an amino acid corresponding to one or more pathogenic mutations provided in Table 1 on pages 65-74 of the specification
  MISC_FEATURE (245)..(248): Xaa can be any naturally occurring amino acid but not an amino acid corresponding to one or more pathogenic mutations provided in Table 1 on pages 65-74 of the specification
  MISC_FEATURE (250)..(250): Xaa can be any naturally occurring amino acid but not an amino acid corresponding to one or more pathogenic mutations provided in Table 1 on pages 65-74 of the specification
  MISC_FEATURE (255)..(256): Xaa can be any naturally occurring amino acid but not an amino acid corresponding to one or more pathogenic mutations provided in Table 1 on pages 65-74 of the specification
  MISC_FEATURE (258)..(260): Xaa can be any naturally occurring amino acid but not an amino acid corresponding to one or more pathogenic mutations provided in Table 1 on pages 65-74 of the specification
  MISC_FEATURE (262)..(274): Xaa can be any naturally occurring amino acid but not an amino acid corresponding to one or more pathogenic mutations provided in Table 1 on pages 65-74 of the specification
  MISC_FEATURE (279)..(279): Xaa can be any naturally occurring amino acid but not an amino acid corresponding to one or more pathogenic mutations provided in Table 1 on pages 65-74 of the specification
  MISC_FEATURE (281)..(288): Xaa can be any naturally occurring amino acid but not an amino acid corresponding to one or more pathogenic mutations provided in Table 1 on pages 65-74 of the specification
  MISC_FEATURE (290)..(291): Xaa can be any naturally occurring amino acid but not an amino acid corresponding to one or more pathogenic mutations provided in Table 1 on pages 65-74 of the specification
  MISC_FEATURE (293)..(293): Xaa can be any naturally occurring amino acid but not an amino acid corresponding to one or more pathogenic mutations provided in Table 1 on pages 65-74 of the specification
  MISC_FEATURE (297)..(297): Xaa can be any naturally occurring amino acid but not an amino acid corresponding to one or more pathogenic mutations provided in Table 1 on pages 65-74 of the specification
  MISC_FEATURE (302)..(302): Xaa can be any naturally occurring amino acid but not an amino acid corresponding to one or more pathogenic mutations provided in Table 1 on pages 65-74 of the specification
  MISC_FEATURE (305)..(306): Xaa can be any naturally occurring amino acid but not an amino acid corresponding to one or more pathogenic mutations provided in Table 1 on pages 65-74 of the specification
  MISC_FEATURE (308)..(311): Xaa can be any naturally occurring amino acid but not an amino acid corresponding to one or more pathogenic mutations provided in Table 1 on pages 65-74 of the specification
  MISC_FEATURE (316)..(316): Xaa can be any naturally occurring amino acid but not an amino acid corresponding to one or more pathogenic mutations provided in Table 1 on pages 65-74 of the specification
  MISC_FEATURE (319)..(321): Xaa can be any naturally occurring amino acid but not an amino acid corresponding to one or more pathogenic mutations provided in Table 1 on pages 65-74 of the specification
  MISC_FEATURE (323)..(325): Xaa can be any naturally occurring amino acid but not an amino acid corresponding to one or more pathogenic mutations provided in Table 1 on pages 65-74 of the specification
  MISC_FEATURE (327)..(331): Xaa can be any naturally occurring amino acid but not an amino acid corresponding to one or more pathogenic mutations provided in Table 1 on pages 65-74 of the specification
  MISC_FEATURE (334)..(334): Xaa can be any naturally occurring amino acid but not an amino acid corresponding to one or more pathogenic mutations provided in Table 1 on pages 65-74 of the specification
  MISC_FEATURE (336)..(336): Xaa can be any naturally occurring amino acid but not an amino acid corresponding to one or more pathogenic mutations provided in Table 1 on pages 65-74 of the specification
  MISC_FEATURE (349)..(350): Xaa can be any naturally occurring amino acid but not an amino acid corresponding to one or more pathogenic mutations provided in Table 1 on pages 65-74 of the specification
  MISC_FEATURE (352)..(353): Xaa can be any naturally occurring amino acid but not an amino acid corresponding to one or more pathogenic mutations provided in Table 1 on pages 65-74 of the specification
  MISC_FEATURE (356)..(356): Xaa can be any naturally occurring amino acid but not an amino acid corresponding to one or more pathogenic mutations provided in Table 1 on pages 65-74 of the specification
  MISC_FEATURE (358)..(361): Xaa can be any naturally occurring amino acid but not an amino acid corresponding to one or more pathogenic mutations provided in Table 1 on pages 65-74 of the specification
  MISC_FEATURE (363)..(363): Xaa can be any naturally occurring amino acid but not an amino acid corresponding to one or more pathogenic mutations provided in Table 1 on pages 65-74 of the specification
  MISC_FEATURE (366)..(367): Xaa can be any naturally occurring amino acid but not an amino acid corresponding to one or more pathogenic mutations provided in Table 1 on pages 65-74 of the specification
  MISC_FEATURE (370)..(371): Xaa can be any naturally occurring amino acid but not an amino acid corresponding to one or more pathogenic mutations provided in Table 1 on pages 65-74 of the specification
  MISC_FEATURE (374)..(375): Xaa can be any naturally occurring amino acid but not an amino acid corresponding to one or more pathogenic mutations provided in Table 1 on pages 65-74 of the specification
  MISC_FEATURE (379)..(380): Xaa can be any naturally occurring amino acid but not an amino acid corresponding to one or more pathogenic mutations provided in Table 1 on pages 65-74 of the specification
  MISC_FEATURE (390)..(390): Xaa can be any naturally occurring amino acid but not an amino acid corresponding to one or more pathogenic mutations provided in Table 1 on pages 65-74 of the specification
  MISC_FEATURE (395)..(396): Xaa can be any naturally occurring amino acid but not an amino acid corresponding to one or more pathogenic mutations provided in Table 1 on pages 65-74 of the specification
  MISC_FEATURE (399)..(399): Xaa can be any naturally occurring amino acid but not an amino acid corresponding to one or more pathogenic mutations provided in Table 1 on pages 65-74 of the specification
  MISC_FEATURE (407)..(411): Xaa can be any naturally occurring amino acid but not an amino acid corresponding to one or more pathogenic mutations provided in Table 1 on pages 65-74 of the specification
  MISC_FEATURE (413)..(413): Xaa can be any naturally occurring amino acid but not an amino acid corresponding to one or more pathogenic mutations provided in Table 1 on pages 65-74 of the specification
  MISC_FEATURE (415)..(416): Xaa can be any naturally occurring amino acid but not an amino acid corresponding to one or more pathogenic mutations provided in Table 1 on pages 65-74 of the specification
  MISC_FEATURE (418)..(419): Xaa can be any naturally occurring amino acid but not an amino acid corresponding to one or more pathogenic mutations provided in Table 1 on pages 65-74 of the specification
  MISC_FEATURE (428)..(431): Xaa can be any naturally occurring amino acid but not an amino acid corresponding to one or more pathogenic mutations provided in Table 1 on pages 65-74 of the specification
  MISC_FEATURE (433)..(433): Xaa can be any naturally occurring amino acid but not an amino acid corresponding to one or more pathogenic mutations provided in Table 1 on pages 65-74 of the specification
  MISC_FEATURE (435)..(436): Xaa can be any naturally occurring amino acid but not an amino acid corresponding to one or more pathogenic mutations provided in Table 1 on pages 65-74 of the specification
  MISC_FEATURE (438)..(446): Xaa can be any naturally occurring amino acid but not an amino acid corresponding to one or more pathogenic mutations provided in Table 1 on pages 65-74 of the specification
  MISC_FEATURE (448)..(449): Xaa can be any naturally occurring amino acid but not an amino acid corresponding to one or more pathogenic mutations provided in Table 1 on pages 65-74 of the specification
  MISC_FEATURE (451)..(451): Xaa can be any naturally occurring amino acid but not an amino acid corresponding to one or more pathogenic mutations provided in Table 1 on pages 65-74 of the specification
  MISC_FEATURE (456)..(457): Xaa can be any naturally occurring amino acid but not an amino acid corresponding to one or more pathogenic mutations provided in Table 1 on pages 65-74 of the specification
  MISC_FEATURE (461)..(461): Xaa can be any naturally occurring amino acid but not an amino acid corresponding to one or more pathogenic mutations provided in Table 1 on pages 65-74 of the specification
  MISC_FEATURE (469)..(470): Xaa can be any naturally occurring amino acid but not an amino acid corresponding to one or more pathogenic mutations provided in Table 1 on pages 65-74 of the specification
  MISC_FEATURE (473)..(473): Xaa can be any naturally occurring amino acid but not an amino acid corresponding to one or more pathogenic mutations provided in Table 1 on pages 65-74 of the specification
  MISC_FEATURE (477)..(477): Xaa can be any naturally occurring amino acid but not an amino acid corresponding to one or more pathogenic mutations provided in Table 1 on pages 65-74 of the specification
  MISC_FEATURE (481)..(481): Xaa can be any naturally occurring amino acid but not an amino acid corresponding to one or more pathogenic mutations provided in Table 1 on pages 65-74 of the specification
  MISC_FEATURE (484)..(487): Xaa can be any naturally occurring amino acid but not an amino acid corresponding to one or more pathogenic mutations provided in Table 1 on pages 65-74 of the specification
  MISC_FEATURE (492)..(492): Xaa can be any naturally occurring amino acid but not an amino acid corresponding to one or more pathogenic mutations provided in Table 1 on pages 65-74 of the specification
  MISC_FEATURE (494)..(494): Xaa can be any naturally occurring amino acid but not an amino acid corresponding to one or more pathogenic mutations provided in Table 1 on pages 65-74 of the specification
  MISC_FEATURE (496)..(507): Xaa can be any naturally occurring amino acid but not an amino acid corresponding to one or more pathogenic mutations provided in Table 1 on pages 65-74 of the specification
  MISC_FEATURE (509)..(524): Xaa can be any naturally occurring amino acid but not an amino acid corresponding to one or more pathogenic mutations provided in Table 1 on pages 65-74 of the specification
  MISC_FEATURE (526)..(532): Xaa can be any naturally occurring amino acid but not an amino acid corresponding to one or more pathogenic mutations provided in Table 1 on pages 65-74 of the specification
  MISC_FEATURE (534)..(541): Xaa can be any naturally occurring amino acid but not an amino acid corresponding to one or more pathogenic mutations provided in Table 1 on pages 65-74 of the specification
XXXXXXXXXXXXXXXXXXXXXXXXXXXEXXPXXWXXXAXXXLXXAXXLQXXXXXXAKNXIXFLGDGMGVXTVTAXRILKGQXXXXXGXEXXLXMDXFPXXALSKTYXXXXXVPDSXXTATAYLCGVKXNXXTXGXSAAXXXXXCNTTXGNEVTSXXXXAKXXGKSVGXVTTTRVXHAXPXXXYAHXXXRXWYSDXXXPXXAXXXGCXDIAXQLXXNXXDIXVIXGGGRKYMXXXXXXDXEYXXDXXXXGXRLDGXXLXXXWXXXXXXXXXXXXXWNRTXLXXXXXXXXVXXLXGLFXPGDMXYEXXRXXXXDPSLXEMXXXAXXXLXXXXXGFXLXVEGGRIDHGHHEXXAXXALXEXXXXDXAIXXAGXXTSXXDTLXXVTADHSHVFXFGGYXXRGXSIFGLAPXXXXXDXKXXTXXLYGNGPGYXXXXGXRXXVXXXXXXXXXYXXQXAVPLXXETHXGEDVAVFXXGPXAHLXHGVXEQXXXXHVMAXAXCXXXXXXXXXXXXAXXXXXXXXXXXXXXXXLXXXXXXXLXXXXXXXX

SEQ ID NO: 1219 - protein, 524 aa, Artificial Sequence
  Synthetic Construct
  MISC_FEATURE (3)..(3): Xaa can be any naturally occurring amino acid but not an amino acid corresponding to one or more pathogenic mutations provided in Table 1 on pages 65-74 of the specification
  MISC_FEATURE (7)..(7): Xaa can be any naturally occurring amino acid but not an amino acid corresponding to one or more pathogenic mutations provided in Table 1 on pages 65-74 of the specification
  MISC_FEATURE (14)..(16): Xaa can be any naturally occurring amino acid but not an amino acid corresponding to one or more pathogenic mutations provided in Table 1 on pages 65-74 of the specification
  MISC_FEATURE (18)..(18): Xaa can be any naturally occurring amino acid but not an amino acid corresponding to one or more pathogenic mutations provided in Table 1 on pages 65-74 of the specification
  MISC_FEATURE (24)..(24): Xaa can be any naturally occurring amino acid but not an amino acid corresponding to one or more pathogenic mutations provided in Table 1 on pages 65-74 of the specification
  MISC_FEATURE (27)..(27): Xaa can be any naturally occurring amino acid but not an amino acid corresponding to one or more pathogenic mutations provided in Table 1 on pages 65-74 of the specification
  MISC_FEATURE (31)..(31): Xaa can be any naturally occurring amino acid but not an amino acid corresponding to one or more pathogenic mutations provided in Table 1 on pages 65-74 of the specification
  MISC_FEATURE (35)..(35): Xaa can be any naturally occurring amino acid but not an amino acid corresponding to one or more pathogenic mutations provided in Table 1 on pages 65-74 of the specification
  MISC_FEATURE (39)..(39): Xaa can be any naturally occurring amino acid but not an amino acid corresponding to one or more pathogenic mutations provided in Table 1 on pages 65-74 of the specification
  MISC_FEATURE (42)..(42): Xaa can be any naturally occurring amino acid but not an amino acid corresponding to one or more pathogenic mutations provided in Table 1 on pages 65-74 of the specification
  MISC_FEATURE (45)..(45): Xaa can be any naturally occurring amino acid but not an amino acid corresponding to one or more pathogenic mutations provided in Table 1 on pages 65-74 of the specification
  MISC_FEATURE (54)..(54): Xaa can be any naturally occurring amino acid but not an amino acid corresponding to one or more pathogenic mutations provided in Table 1 on pages 65-74 of the specification
  MISC_FEATURE (70)..(70): Xaa can be any naturally occurring amino acid but not an amino acid corresponding to one or more pathogenic mutations provided in Table 1 on pages 65-74 of the specification
  MISC_FEATURE (80)..(81): Xaa can be any naturally occurring amino acid but not an amino acid corresponding to one or more pathogenic mutations provided in Table 1 on pages 65-74 of the specification
  MISC_FEATURE (86)..(86): Xaa can be any naturally occurring amino acid but not an amino acid corresponding to one or more pathogenic mutations provided in Table 1 on pages 65-74 of the specification
  MISC_FEATURE (94)..(94): Xaa can be any naturally occurring amino acid but not an amino acid corresponding to one or more pathogenic mutations provided in Table 1 on pages 65-74 of the specification
  MISC_FEATURE (135)..(135): Xaa can be any naturally occurring amino acid but not an amino acid corresponding to one or more pathogenic mutations provided in Table 1 on pages 65-74 of the specification
  MISC_FEATURE (137)..(138): Xaa can be any naturally occurring amino acid but not an amino acid corresponding to one or more pathogenic mutations provided in Table 1 on pages 65-74 of the specification
  MISC_FEATURE (157)..(157): Xaa can be any naturally occurring amino acid but not an amino acid corresponding to one or more pathogenic mutations provided in Table 1 on pages 65-74 of the specification
  MISC_FEATURE (177)..(177): Xaa can be any naturally occurring amino acid but not an amino acid corresponding to one or more pathogenic mutations provided in Table 1 on pages 65-74 of the specification
  MISC_FEATURE (210)..(210): Xaa can be any naturally occurring amino acid but not an amino acid corresponding to one or more pathogenic mutations provided in Table 1 on pages 65-74 of the specification
  MISC_FEATURE (212)..(213): Xaa can be any naturally occurring amino acid but not an amino acid corresponding to one or more pathogenic mutations provided in Table 1 on pages 65-74 of the specification
  MISC_FEATURE (216)..(216): Xaa can be any naturally occurring amino acid but not an amino acid corresponding to one or more pathogenic mutations provided in Table 1 on pages 65-74 of the specification
  MISC_FEATURE (227)..(227): Xaa can be any naturally occurring amino acid but not an amino acid corresponding to one or more pathogenic mutations provided in Table 1 on pages 65-74 of the specification
  MISC_FEATURE (231)..(231): Xaa can be any naturally occurring amino acid but not an amino acid corresponding to one or more pathogenic mutations provided in Table 1 on pages 65-74 of the specification
  MISC_FEATURE (238)..(238): Xaa can be any naturally occurring amino acid but not an amino acid corresponding to one or more pathogenic mutations provided in Table 1 on pages 65-74 of the specification
  MISC_FEATURE (242)..(243): Xaa can be any naturally occurring amino acid but not an amino acid corresponding to one or more pathogenic mutations provided in Table 1 on pages 65-74 of the specification
  MISC_FEATURE (245)..(245): Xaa can be any naturally occurring amino acid but not an amino acid corresponding to one or more pathogenic mutations provided in Table 1 on pages 65-74 of the specification
  MISC_FEATURE (251)..(251): Xaa can be any naturally occurring amino acid but not an amino acid corresponding to one or more pathogenic mutations provided in Table 1 on pages 65-74 of the specification
  MISC_FEATURE (253)..(255): Xaa can be any naturally occurring amino acid but not an amino acid corresponding to one or more pathogenic mutations provided in Table 1 on pages 65-74 of the specification
  MISC_FEATURE (258)..(258): Xaa can be any naturally occurring amino acid but not an amino acid corresponding to one or more pathogenic mutations provided in Table 1 on pages 65-74 of the specification
  MISC_FEATURE (262)..(263): Xaa can be any naturally occurring amino acid but not an amino acid corresponding to one or more pathogenic mutations provided in Table 1 on pages 65-74 of the specification
  MISC_FEATURE (268)..(269): Xaa can be any naturally occurring amino acid but not an amino acid corresponding to one or more pathogenic mutations provided in Table 1 on pages 65-74 of the specification
  MISC_FEATURE (274)..(274): Xaa can be any naturally occurring amino acid but not an amino acid corresponding to one or more pathogenic mutations provided in Table 1 on pages 65-74 of the specification
  MISC_FEATURE (277)..(277): Xaa can be any naturally occurring amino acid but not an amino acid corresponding to one or more pathogenic mutations provided in Table 1 on pages 65-74 of the specification
  MISC_FEATURE (281)..(282): Xaa can be any naturally occurring amino acid but not an amino acid corresponding to one or more pathogenic mutations provided in Table 1 on pages 65-74 of the specification
  MISC_FEATURE (291)..(291): Xaa can be any naturally occurring amino acid but not an amino acid corresponding to one or more pathogenic mutations provided in Table 1 on pages 65-74 of the specification
  MISC_FEATURE (303)..(304): Xaa can be any naturally occurring amino acid but not an amino acid corresponding to one or more pathogenic mutations provided in Table 1 on pages 65-74 of the specification
  MISC_FEATURE (314)..(315): Xaa can be any naturally occurring amino acid but not an amino acid corresponding to one or more pathogenic mutations provided in Table 1 on pages 65-74 of the specification
  MISC_FEATURE (317)..(318): Xaa can be any naturally occurring amino acid but not an amino acid corresponding to one or more pathogenic mutations provided in Table 1 on pages 65-74 of the specification
  MISC_FEATURE (321)..(321): Xaa can be any naturally occurring amino acid but not an amino acid corresponding to one or more pathogenic mutations provided in Table 1 on pages 65-74 of the specification
  MISC_FEATURE (323)..(325): Xaa can be any naturally occurring amino acid but not an amino acid corresponding to one or more pathogenic mutations provided in Table 1 on pages 65-74 of the specification
  MISC_FEATURE (357)..(357): Xaa can be any naturally occurring amino acid but not an amino acid corresponding to one or more pathogenic mutations provided in Table 1 on pages 65-74 of the specification
  MISC_FEATURE (361)..(361): Xaa can be any naturally occurring amino acid but not an amino acid corresponding to one or more pathogenic mutations provided in Table 1 on pages 65-74 of the specification
  MISC_FEATURE (364)..(365): Xaa can be any naturally occurring amino acid but not an amino acid corresponding to one or more pathogenic mutations provided in Table 1 on pages 65-74 of the specification
  MISC_FEATURE (368)..(369): Xaa can be any naturally occurring amino acid but not an amino acid corresponding to one or more pathogenic mutations provided in Table 1 on pages 65-74 of the specification
  MISC_FEATURE (374)..(374): Xaa can be any naturally occurring amino acid but not an amino acid corresponding to one or more pathogenic mutations provided in Table 1 on pages 65-74 of the specification
  MISC_FEATURE (402)..(402): Xaa can be any naturally occurring amino acid but not an amino acid corresponding to one or more pathogenic mutations provided in Table 1 on pages 65-74 of the specification
  MISC_FEATURE (412)..(412): Xaa can be any naturally occurring amino acid but not an amino acid corresponding to one or more pathogenic mutations provided in Table 1 on pages 65-74 of the specification
  MISC_FEATURE (425)..(425): Xaa can be any naturally occurring amino acid but not an amino acid corresponding to one or more pathogenic mutations provided in Table 1 on pages 65-74 of the specification
  MISC_FEATURE (463)..(463): Xaa can be any naturally occurring amino acid but not an amino acid corresponding to one or more pathogenic mutations provided in Table 1 on pages 65-74 of the specification
  MISC_FEATURE (475)..(475): Xaa can be any naturally occurring amino acid but not an amino acid corresponding to one or more pathogenic mutations provided in Table 1 on pages 65-74 of the specification
  MISC_FEATURE (480)..(480): Xaa can be any naturally occurring amino acid but not an amino acid corresponding to one or more pathogenic mutations provided in Table 1 on pages 65-74 of the specification
  MISC_FEATURE (488)..(488): Xaa can be any naturally occurring amino acid but not an amino acid corresponding to one or more pathogenic mutations provided in Table 1 on pages 65-74 of the specification
  MISC_FEATURE (494)..(495): Xaa can be any naturally occurring amino acid but not an amino acid corresponding to one or more pathogenic mutations provided in Table 1 on pages 65-74 of the specification
  MISC_FEATURE (499)..(499): Xaa can be any naturally occurring amino acid but not an amino acid corresponding to one or more pathogenic mutations provided in Table 1 on pages 65-74 of the specification
  MISC_FEATURE (501)..(501): Xaa can be any naturally occurring amino acid but not an amino acid corresponding to one or more pathogenic mutations provided in Table 1 on pages 65-74 of the specification
  MISC_FEATURE (503)..(508): Xaa can be any naturally occurring amino acid but not an amino acid corresponding to one or more pathogenic mutations provided in Table 1 on pages 65-74 of the specification
  MISC_FEATURE (510)..(510): Xaa can be any naturally occurring amino acid but not an amino acid corresponding to one or more pathogenic mutations provided in Table 1 on pages 65-74 of the specification
  MISC_FEATURE (512)..(512): Xaa can be any naturally occurring amino acid but not an amino acid corresponding to one or more pathogenic mutations provided in Table 1 on pages 65-74 of the specification
  MISC_FEATURE (514)..(514): Xaa can be any naturally occurring amino acid but not an amino acid corresponding to one or more pathogenic mutations provided in Table 1 on pages 65-74 of the specification
  MISC_FEATURE (517)..(522): Xaa can be any naturally occurring amino acid but not an amino acid corresponding to one or more pathogenic mutations provided in Table 1 on pages 65-74 of the specification
MIXPFLXLAIGTCXXXSXVPEKEXDPXYWRXQAQXTLKXALXLQXLNTNVAKNXIMFLGDGMGVSTVTAXRILKGQLHHXXGEETXLEMDKFPXVALSKTYNTNAQVPDSAGTATAYLCGVKANEGTVGVSAATXRXXCNTTQGNEVTSILRWAKDXGKSVGIVTTTRVNHATPSAXYAHSADRDWYSDNEMPPEALSQGCKDIAYQLMXNXXDIXVIMGGGRKYMXPKNXTDVEYEXDEKXXGXRLDGLXLXXXWKXFKPXXKHSHXXWNRTXLLXLDPXXVDYLLGLFXPGDMQYELNRNXXTDPSLSEMVXXAXXILXKXXXGFFLLVEGGRIDHGHHEGKAKQALHEAVEMDXAIGXAGXXTSXXDTLTXVTADHSHVFTFGGYTPRGNSIFGLAPMXSDTDKKPFTXILYGNGPGYKVVXGERENVSMVDYAHNNYQAQSAVPLRHETHGGEDVAVFXKGPMAHLLHGVXEQNYXPHVMAYAXCIGANXXHCAXAXSXXXXXXGXLXLXLAXXXXXXLF

SEQ ID NO: 1220 - protein, 731 aa, Artificial Sequence
  Synthetic Construct
MVSPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSLKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1221 - protein, 714 aa, Artificial Sequence
  Synthetic Construct
LVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSLKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

What is claimed is:

1. A method of treating a neurocutaneous syndrome in a subject, said method comprising administering to said subject a therapeutically effective amount of a pharmaceutical composition comprising:
(a) a polypeptide comprising the structure A-sALP-B; and
(b) a pharmaceutically acceptable excipient,
wherein sALP is the extracellular domain of an alkaline phosphatase,
A is absent or is an amino acid sequence of at least one amino acid, and
B is absent or is an amino acid sequence of at least one amino acid,
thereby treating said syndrome in said subject.

2. The method of claim 1, wherein the polypeptide comprises an amino acid sequence selected from any one of SEQ ID NOs: 1201, 1204, 1220, and 1221.

3. The method of claim 1, wherein
the amino acid sequence of said sALP comprises amino acid residues 23-508 of SEQ ID NO: 1215, amino acid residues 18-498 of SEQ ID NO: 1216, amino acid residues 23-508 of SEQ ID NO: 1218, or amino acid residues 18-498 of SEQ ID NO: 1219, or
the amino acid sequence of said sALP consists of amino acid residues 23-512 of SEQ ID NO: 1215, amino acid residues 18-502 of SEQ ID NO: 1216, amino acid residues 23-512 of SEQ ID NO: 1218, or amino acid residues 18-502 of SEQ ID NO: 1219.

4. The method of claim 1, wherein the amino acid sequence of said sALP comprises an amino acid sequence having at least 85% sequence identity to SEQ ID NO: 1205.

5. The method of claim 1, wherein A or B comprises a fragment crystallizable region (Fc) or a bone-targeting moiety.

6. The method of claim 1, wherein said neurocutaneous syndrome is neurofibromatosis type I.

7. A method of treating a neurocutaneous syndrome in a subject, said method comprising administering to said subject a therapeutically effective amount of a pharmaceutical composition comprising:
(a) a polypeptide comprising the structure V-NP-W; and
(b) a pharmaceutically acceptable excipient,
wherein NP is a natriuretic peptide that is an agonist of natriuretic peptide receptor B (NPR-B),
V is absent or is an amino acid sequence of at least one amino acid, and
W is absent or is an amino acid sequence of at least one amino acid,
thereby treating said syndrome in said subject.

8. The method of claim 7, wherein the polypeptide comprises the amino acid sequence of SEQ ID NOs: 504, 512, 530, or 572.

9. The method of claim 7, wherein V or W comprises a fragment crystallizable region (Fc) or a bone-targeting moiety.

10. The method of claim 7, wherein the polypeptide comprises the amino acid sequence of any one of SEQ ID NOs: 501-608.

11. The method of claim 7, wherein said neurocutaneous syndrome is neurofibromatosis type I.

12. The method of claim 7, wherein said NP comprises the structure:
[N-terminal extension]-[short segment]-[ring domain]-[C-terminal extension],
wherein said ring domain comprises the amino acid sequence of SEQ ID NO: 6, amino acid residues 11-27 of SEQ ID NO: 30, or SEQ ID NO: 95, and each of said N-terminal extension, short segment, and C-terminal extension is, independently, absent or is an amino acid sequence of at least one amino acid.

13. The method of claim 12, wherein said ring domain comprises amino acid residues 6-22 of SEQ ID NO: 126.

14. A method of treating a disease or a condition in a subject, said method comprising administering to said subject a therapeutically effective amount of a first polypeptide and a second polypeptide, wherein
a) said first polypeptide comprises the structure A-sALP-B, wherein
i) sALP is the extracellular domain of an alkaline phosphatase,
ii) A is absent or is an amino acid sequence of at least one amino acid, and
iii) B is absent or is an amino acid sequence of at least one amino acid; and
b) said second polypeptide comprises the structure V-NP-W, wherein
i) NP is a natriuretic peptide that is an agonist of natriuretic peptide receptor B (NPR-B),
ii) V is absent or is an amino acid sequence of at least one amino acid, and
iii) W is absent or is an amino acid sequence of at least one amino acid; and
said disease or condition is selected from the group consisting of a neurocutaneous syndrome, a disorder associated with overactivation of FGFR3, a bone or cartilage disorder, a vascular smooth muscle disorder, and a condition for elongation of bone,
thereby treating said disease or said condition in said subject.

15. The method of claim 14, wherein said first polypeptide and said second polypeptide are administered together in a composition or are administered in separate compositions.

16. The method of claim 14, wherein said disease is said neurocutaneous syndrome.

17. The method of claim 16, wherein said neurocutaneous syndrome is neurofibromatosis type I.

* * * * *